US009499827B2

United States Patent
Bermudez et al.

(10) Patent No.: US 9,499,827 B2
(45) Date of Patent: Nov. 22, 2016

(54) COMPOSITIONS AND METHODS COMPRISING SEQUENCES HAVING MEGANUCLEASE ACTIVITY

(71) Applicants: E I DU PONT DE NEMOURS AND COMPANY, Wilmington, DE (US); PIONEER HI BRED INTERNATIONAL INC, Johnston, IA (US)

(72) Inventors: Ericka Bermudez, Aptos, CA (US); Andrew Mark Cigan, Johnston, IA (US); James English, San Ramon, CA (US); Saverio Carl Falco, Wilmington, DE (US); Huirong Gao, Johnston, IA (US); Lu Liu, Palo Alto, CA (US); Zhan-Bin Liu, West Chester, PA (US); Azalea Ong, Castro Valley, CA (US); Sergei Svitashev, Johnston, IA (US); Joshua K Young, Johnston, IA (US)

(73) Assignees: E I DU PONT DE NEMOURS AND COMPANY, Wilmington, DE (US); PIONEER HI-BRED INTERNATIONAL, INC., Johnston, IA (US)

( * ) Notice: Subject to any disclaimer, the term of this patent is extended or adjusted under 35 U.S.C. 154(b) by 532 days.

(21) Appl. No.: 13/886,317

(22) Filed: May 3, 2013

(65) Prior Publication Data
US 2014/0223606 A1 Aug. 7, 2014

Related U.S. Application Data

(60) Provisional application No. 61/683,765, filed on Aug. 16, 2012, provisional application No. 61/642,470, filed on May 4, 2012.

(51) Int. Cl.
*C12N 15/82* (2006.01)
*C12N 5/14* (2006.01)
*C12N 9/22* (2006.01)
*C12N 9/16* (2006.01)
*C12N 15/81* (2006.01)

(52) U.S. Cl.
CPC .......... *C12N 15/8213* (2013.01); *C12N 9/16* (2013.01); *C12N 9/22* (2013.01); *C12N 15/81* (2013.01)

(58) Field of Classification Search
None
See application file for complete search history.

(56) References Cited

U.S. PATENT DOCUMENTS

| 2007/0117128 A1* | 5/2007 | Smith | C12N 9/22 435/6.12 |
| 2009/0133152 A1* | 5/2009 | Lyznik | C12N 9/22 800/275 |
| 2010/0071083 A1* | 3/2010 | Smith | A01H 1/06 800/278 |

FOREIGN PATENT DOCUMENTS

| WO | 03/078619 A1 | 9/2003 |
| WO | 2004/031346 A2 | 4/2004 |
| WO | 2005/105989 A1 | 11/2005 |
| WO | 2006/097784 A1 | 9/2006 |
| WO | 2006/097853 A1 | 9/2006 |
| WO | 2006/097854 A1 | 9/2006 |
| WO | 2007/047859 A1 | 4/2007 |
| WO | 2008/102198 A1 | 8/2008 |
| WO | 2009/059195 A2 | 5/2009 |
| WO | 2009/114321 A2 | 9/2009 |
| WO | 2010/079430 A1 | 7/2010 |

OTHER PUBLICATIONS

Patrick Chames et al., In vivo selection of engineered homing endonucleases using double-strand break induced homologous recombination, Nucleic Acids Research, 2005, vol. 33, No. 20 e178.
Zhilei Chen et al., A highly sensitive selection method for directed evolution of homing endonucleases, Nucleic Acids Research, 2005, vol. 33, No. 18 e154.
Brett S. Chevalier et al., Design, Activity, and Structure of a Highly Specific Artificial Endonuclease, Molecular Cell, Oct. 2002, pp. 895-905, vol. 10.
Michelle Christian et al., Targeting DNA Double-Strand Breaks with TAL Effector Nucleases, Genetics, Oct. 2010, pp. 757-761, vol. 186.
Jeffrey B. Doyan et al., Directed Evolution and Substrate Specificity Profile of Homing Endonuclease I-Scel, J. Am. Chem. Soc, 2006, pp. 2447-2484.
Jean-Charles Epinat et al., A novel engineered meganuclease induces homologous recombination in yeast and mammalian cells, Nucleic Acids Research, 2003, pp. 2952-2962, vol. 31, No. 11.
Frederick S. Gimble et al., Assessing the Plasticity of DNA Target Site Recognition of the PI-Scel Homing Endonuclease Using a Bacterial Two-hybrid Selection System, J. Mol. Biol., 2003, pp. 993-1008, vol. 334.

(Continued)

*Primary Examiner* — Brent Page
*Assistant Examiner* — Matthew Keogh

(57) ABSTRACT

Compositions and methods comprising polynucleotides and polypeptides having meganuclease activity are provided. Further provided are nucleic acid constructs, yeast, plants, plant cells, explants, seeds and grain having the meganuclease sequences. Various methods of employing the meganuclease sequences are provided. Such methods include, for example, methods for producing a meganuclease with increased activity at a wide range of temperatures, methods for producing a yeast, plant, plant cell, explant or seed comprising a meganuclease with increased activity.

21 Claims, 47 Drawing Sheets

(56) References Cited

OTHER PUBLICATIONS

Mathias Gruen et al., An in vivio selection system for homing endonuclease activity, Nucleic Acids Research, 2002, vol. 30, No. 7 e29.

N. Guhan et al., Structural and Functional Characteristics of Homing Endonucleases, Critical Reviews in Biochemistry and Molecular Biology, 2003, pp. 199-248, vol. 38(3).

M. S. Jurica et al., Homing endonucleases: structure, function and evolution, Cell. Mol. Life Sci. 1999, pp. 1304-1326, vol. 55.

Ting Li et al., TAL nucleases (TALNs): hybrid proteins composed of TAL effectors and Fokl DNA-cleavage domain, Nucleic Acids Research, 2011, pp. 359-372, vol. 39, No. 1.

Patrick Lucas et al., Rapid evolution of the DNA-binding site in LAGLIDADG homing endonucleases, Nucleic Acids Research, 2001, pp. 960-969, vol. 29, No. 4.

Jeffrey C Miller et al., A Tale nuclease architecture for efficient genome editing, Nature Biotechnology, Feb. 2011, pp. 143-148, vol. 29, No. 2.

Robert Morbitzer et al., Regulation of selected genome loci using de novo-engineered transcription activator-like effector (TALE)-type transcription factors, PNAS, Dec. 14, 2010, pp. 21617-21622, vol. 107, No. 50.

Carmen M. Moure et al., Crystal structure of the intein homing endonuclease PI-Scel bound to its recognition sequence, Nature Structural Biology, Oct. 2002, vol. 9, No. 10.

Laura E. Rosen et al., Homing endonuclease I-CreI derivatives with novel DNA target specificities, Nucleic Acids Research, 2006, pp. 4791-4800, vol. 34, No. 17.

Heidi Scholz et al., TAL effector—DNA specificity, Virulence, Sep./Oct. 2010, pp. 428-432, vol. 1, Issue 5.

Lenny M. Seligman et al., Mutations altering the cleavage specificity of a homing endonuclease, Nucleic Acids Research, 2002, pp. 3870-3879, vol. 30, No. 17.

Julianne Smith et al., A combinatorial approach to create artificial homing endonucleases cleaving chosen sequences, Nucleic Acids Research, 2006, vol. 34, No. 22 e149.

Barry L. Stoddard, Homing endonuclease structure and function, Quarterly Reviews of Biophysics, 2006, pp. 49-95, vol. 38.

Django Sussman et al., Isolation and Characterization of New Homing Endonuclease Specificities at Individual Target Site Positions, J. Mol. Biol, 2004, pp. 31-41, vol. 342.

International Search Report—PCT/US2013/039011, mailed Oct. 11, 2013.

* cited by examiner

FIG. 1B

LIG34 30deg

2% galactose

Meganuclease Expression Plasmid

| | 330 | 340 | 350 |
|---|---|---|---|
| LG3-4.pro | ALNDSKTRKTTSETVRAVLDSLSEKKKSSP | | 350 |
| LG3-4(7).pro | ALNDSKTRKTTSETVRAVLDSLSEKKKSSP | | 350 |
| LG3-4(15).pro | ALNDSKTRKTTSETVRAVLDSLSEKKKSSP | | 350 |
| LG3-4(B65).pro | ALNDSKTRKTTSETVRAVLDSLSEKKKSSP | | 350 |
| LG3-4(A4).pro | ALNDSKTRKTTSETVRAVLDSLSEKKKSSP | | 350 |
| LG3-4(A6).pro | ALNDSKTRKTTSETVRAVLDSLSEKKKSSP | | 350 |
| LG3-4(D5).pro | ALNDSKTRKTTSETVRAVLDSLSEKKKSSP | | 350 |
| LG3-4(D7).pro | ALNDSKTRKTTSETVRAVLDSLSEKKKSSP | | 350 |
| LG3-4(D8).pro | ALNDSKTRKTTSETVRAVLDSLSEKKKSSP | | 350 |
| LG3-4(B70).pro | ALNDSKTRKTTSETVRAVLDSLSEKKKSSP | | 350 |
| LG3-4(B75).pro | ALNDSKTRKTTSETVRAVLDSLSEKKKSSP | | 350 |
| LG3-4(B76).pro | ALNDSKTRKTTSETVRAVLDSLSEKKKSSP | | 350 |
| LG3-4(B73).pro | ALNDSKTRKTTSETVRAVLDSLSEKKKSSP | | 350 |
| LG3-4(B82).pro | ALNDSKTRKTTSETVRAVLDSLSEKKKSSP | | 350 |
| LG3-4(B78).pro | ALNDSKTRKTTSETVRAVLDSLSENNKSSP | | 350 |
| LG3-4(B1).pro | ALNDSKTRKTTSETVRAVLDSLSEKKKSSP | | 350 |
| LG3-4(B15).pro | ALNDSKTRKTTSETVRAVLDSLSEKKKSSP | | 350 |
| LG3-4(B71).pro | ALNDSKTRKTTSETVRAVLDSLSEKKKSSP | | 350 |
| LG3-4(C1).pro | ALNDSKTRKTTSETVRAVLDSLSENNKSSP | | 350 |
| LG3-4(B39).pro | ALNDSKTRKTTSETVRAVLDSLSENNKSSP | | 350 |
| LG3-4(B16).pro | ALNDSKTRKTTSETVRAVLDSLSEKKKSSP | | 350 |
| LG3-4(B24).pro | ALNDSKTRKTTSETVRAVLDSLSEKKKSSP | | 350 |
| LG3-4(B36).pro | ALNDSKTRKTTSETVRAVLDSLSEKKKSSP | | 350 |
| LG3-4(B40).pro | ALNDSKTRKTTSETVRAVLDSLSEKKKSSP | | 350 |
| LG3-4(B55).pro | ALNDSKTRKTTSETVRAVLDSLSEKKKSSP | | 350 |
| LG3-4(B38).pro | ALNDSKTRKTTSETVRAVLDSLSEKKKSSP | | 350 |

FIG. 5E

Plasmid DNA Substrate, 23C

Plasmid DNA Substrate, 28C

Plasmid DNA Substrate, 37C

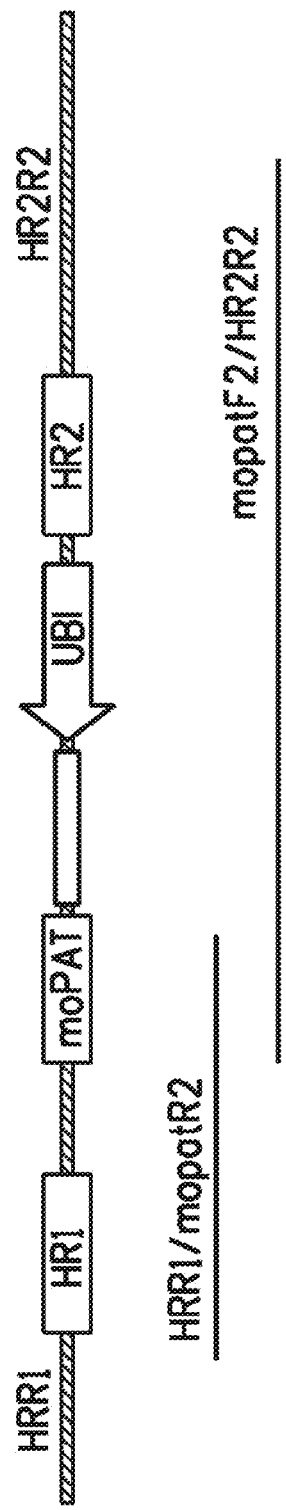
F I G. 8A

| MHP77 | 2 N | 12 Y | 16 F | 19 G | 22 S | 23 I | 28 K | 30 E | 32 C | 43 F | 50 Q | 54 F | 56 D | 58 L | 59 V |
|---|---|---|---|---|---|---|---|---|---|---|---|---|---|---|---|
| MHP77(L15-31) | – | – | – | – | – | – | – | – | – | – | – | – | – | – | – |
| MHP77(L16-11) | – | – | – | – | – | – | – | – | R | – | – | – | – | – | – |
| MHP77(L16-09) | – | – | – | A | – | – | R | – | – | – | – | – | L | – | – |
| MHP77(L16-04) | – | – | – | – | – | – | – | – | R | – | R | – | – | – | – |
| MHP77(L16-19) | – | – | – | – | – | – | – | – | – | – | R | – | – | – | – |
| MHP77(L16-17) | – | – | – | – | – | – | – | – | R | – | – | – | L | – | – |
| MHP77(L16-23) | – | H | – | – | – | – | – | – | R | – | – | – | – | – | – |
| MHP77(L15-34) | – | – | – | – | – | – | – | – | R | – | – | – | – | – | – |
| MHP77(L15-40) | – | – | – | – | – | – | – | – | R | – | – | – | – | – | – |
| MHP77(L15-39) | D | – | – | – | – | – | – | – | R | – | – | – | – | – | – |
| MHP77(L15-45) | – | H | – | – | – | – | – | – | R | – | R | – | – | – | – |
| MHP77(L15-29) | – | H | – | – | – | – | – | – | R | – | R | – | – | – | – |
| MHP77(L15-06) | – | – | – | – | – | – | – | – | R | – | – | – | – | – | – |
| MHP77(L16-08) | – | – | – | – | – | – | – | – | R | – | – | – | – | – | – |
| MHP77(L16-05) | – | – | – | – | – | – | – | – | R | – | R | – | – | – | – |
| MHP77(L16-02) | – | – | – | – | – | – | R | – | – | – | – | – | – | – | – |
| MHP77(L16-24) | – | – | – | – | – | – | – | – | – | – | – | – | – | – | – |
| MHP77(L16-21) | – | – | – | A | – | – | – | – | R | – | – | – | – | – | – |

FIG. 9A

| | 72 S | 73 V | 81 I | 82 K | 86 N | 91 L | 95 L | 98 K | 103 N | 105 V | 111 Q | 113 P | 114 S | 120 D |
|---|---|---|---|---|---|---|---|---|---|---|---|---|---|---|
| MHP77 | | | | | | | | | | | | | | |
| MHP77(L15-31) | - | A | - | - | - | - | - | - | - | - | - | - | - | - |
| MHP77(L16-11) | - | A | - | - | - | - | - | - | - | - | - | - | - | - |
| MHP77(L16-09) | - | A | - | - | - | - | - | - | - | - | - | - | - | - |
| MHP77(L16-04) | - | - | - | - | - | - | - | - | - | - | - | - | - | - |
| MHP77(L16-19) | - | A | K | - | - | - | - | - | - | A | - | - | P | - |
| MHP77(L16-17) | T | A | - | - | - | - | - | - | - | - | - | - | - | - |
| MHP77(L16-23) | - | A | - | - | - | - | - | - | - | - | - | - | - | - |
| MHP77(L15-34) | - | A | - | - | - | - | - | - | - | - | - | - | - | - |
| MHP77(L16-40) | - | - | - | - | - | - | - | - | - | - | - | - | - | - |
| MHP77(L15-39) | - | A | - | - | - | - | - | - | - | A | - | S | - | - |
| MHP77(L15-45) | - | A | - | - | - | - | - | - | - | A | - | - | - | - |
| MHP77(L15-29) | T | A | K | - | D | - | - | - | - | A | - | - | - | - |
| MHP77(L15-06) | - | - | - | - | - | - | - | - | - | - | - | - | - | - |
| MHP77(L16-08) | - | A | - | - | - | - | - | - | - | - | - | - | - | - |
| MHP77(L16-05) | T | A | - | - | - | - | - | - | - | - | - | - | - | - |
| MHP77(L16-02) | - | - | - | - | - | - | - | - | - | - | - | - | - | - |
| MHP77(L16-24) | - | - | - | - | - | - | - | - | - | - | - | - | - | - |
| MHP77(L16-21) | T | A | - | - | - | - | - | - | - | - | - | - | - | - |

FIG. 9B

| | 2 | 12 | 16 | 19 | 22 | 23 | 28 | 30 | 32 | 43 | 50 | 54 | 56 | 58 | 59 |
|---|---|---|---|---|---|---|---|---|---|---|---|---|---|---|---|
| | N | Y | F | G | S | I | K | E | C | F | Q | F | D | L | V |
| MHP77 | | | | | | | | | | | | | | | A |
| MHP77(L16-14) | D | | | | | | | | | | | | | | |
| MHP77(L16-18) | | H | | | | | | | R | | R | | | | |
| MHP77(L15-27) | | | | | | | | | R | | R | | | | |
| MHP77(L9-02) | | | | | | | | | | | | L | | | |
| MHP77(L16-12) | | | | | | | | | R | | | L | L | | |
| MHP77(L16-01) | | H | | | | | | | R | | | | | | |
| MHP77(L15-05) | | | | | | | | | R | | | L | | | |
| MHP77(L15-24) | | | | | | | | | R | | R | | | | |
| MHP77(L16-06) | | | | | | | | | R | | R | | | | |
| MHP77(L16-15) | | | | | | | R | | | | | | | | |
| MHP77(L15-33) | | H | | S | | | | | R | | | | | | |
| MHP77(L16-03) | | | | | | | | | R | | | | | | |
| MHP77(L15-47) | | H | | S | | | R | | | | R | | | | |
| MHP77(L15-46) | | H | | | | | | | R | | | L | L | L | |
| MHP77(L9-12) | | | | | | | R | | R | | | | | | |
| MHP77(L16-16) | | | | | | | | | | | | | | | |
| MHP77(L15-10) | | H | | | | | | | | | R | | | | A |

FIG. 9C

| | 72 | 73 | 81 | 82 | 86 | 91 | 95 | 98 | 103 | 105 | 111 | 113 | 114 | 120 |
|---|---|---|---|---|---|---|---|---|---|---|---|---|---|---|
| MHP77 | S | V | I | K | N | L | L | K | N | V | Q | P | S | D |
| MHP77(L16-14) | | | | | | | | | | | | | | |
| MHP77(L16-18) | | | | | | | | | | | | | | |
| MHP77(L15-27) | | A | | | | | | | | A | | | | |
| MHP77(L9-02) | | | K | | | | | | V | | | | | |
| MHP77(L16-12) | | A | | | | | | | | | | | | |
| MHP77(L16-01) | | | | | | | | | | | | | | |
| MHP77(L15-05) | | A | | | | | | | | | | | | |
| MHP77(L15-24) | | A | | | | | | | | | | | | |
| MHP77(L16-06) | T | A | | | | | | | | | | | | |
| MHP77(L16-15) | | A | K | | | | | | | A | | | | |
| MHP77(L16-33) | | A | | | | | | | | | | | | |
| MHP77(L16-03) | | | | | | | | | | | | | | |
| MHP77(L15-47) | | | | | D | | | | | | | | | |
| MHP77(L15-46) | | | | | | | | | | | | | | E |
| MHP77(L9-12) | | | | | | | | | | | | | | |
| MHP77(L16-16) | | | | | | | | | | | | | | |
| MHP77(L15-10) | | A | | | | | | | | | | | | |

FIG. 9D

| | 2 N | 12 Y | 16 F | 19 G | 22 S | 23 I | 28 K | 30 E | 32 C | 43 F | 50 Q | 54 F | 56 Q | 58 L | 59 V |
|---|---|---|---|---|---|---|---|---|---|---|---|---|---|---|---|
| MHP77 | | | | | | | | | | | | | | | |
| MHP77(L9-03) | | | | S | | | | | | | | - | L | | |
| MHP77(L15-20) | | H | | | | | | | R | | | | | | |
| MHP77(L15-28) | | | | | | | | | R | L | | - | | | |
| MHP77(L15-21) | | H | | | | | | | | | | | | | |
| MHP77(L15-13) | | | | | C | | | | R | | | | | | A |
| MHP77(L9-04) | | | | A | | | | | | | | - | | - | |
| MHP77(L15-18) | | H | | A | | | | | | | | | | | |
| MHP77(L18-01) | | | | | | | | | R | | | | | | |
| MHP77(L17-12) | | | | | | L | | | | | | - | | | A |
| MHP77(L17-01) | | | | | | | | | R | | | | | | |
| MHP77(L15-03) | | H | | | | | R | | | | | | | | |
| MHP77(L15-11) | | H | | S | C | | | | R | | | | | | |
| MHP77(L18-12) | | | | S | | | | | | | | | | | |
| MHP77(L15-15) | | | - | S | | | | | R | | R | | | | H |
| MHP77(L15-12) | | | - | | | | | | | | R | | | | H |
| MHP77(L9-1)* | | | - | | | | | | | | X | | | | H |
| MHP77(L9-9) | | | | | | | | | | | X | | | | |
| MHP77(L9-11) | | | | | | | | | R | | | | L | | |
| MHP77(L9-10) | | | | | | | | | R | | R | | | | |
| MHP77(L15-02) | | | | | | | | | R | | | | | | |
| MHP77(L15-08) | D | | | | | | | | R | | | | | | A |
| MHP77(L16-07) | | | | | | | | | R | | R | | | | |
| MHP77(L15-35) | | | | | | | | | R | | R | | | | |

| | 72 | 73 | 81 | 82 | 86 | 91 | 95 | 98 | 103 | 105 | 111 | 113 | 114 | 120 |
|---|---|---|---|---|---|---|---|---|---|---|---|---|---|---|
| | S | V | L | K | N | L | L | K | N | V | Q | P | S | O |
| MHP77 | | | K | | | | | | V | | | | | |
| MHP77(L9-03) | | A | | | | | | | | A | | | | |
| MHP77(L15-20) | | A | | | | | | | | A | | | | |
| MHP77(L15-28) | | A | | | | | | | | | | | | |
| MHP77(L15-21) | | A | | | | | | | | | | S | | |
| MHP77(L9-04) | | | | | | | | | | | | | | |
| MHP77(L15-18) | | A | | | | | | | | | | | | |
| MHP77(L18-01) | T | | | | Q | | | | | | | | | |
| MHP77(L17-12) | | | | | | | | | | | | | | |
| MHP77(L17-01) | | A | | | | | | | | | | | | |
| MHP77(L15-03) | | | | | | | | | | | | | | |
| MHP77(L15-11) | | A | | K | | | | | | A | | | | |
| MHP77(L18-12) | T | A | | | | | | | | | | | | |
| MHP77(L15-15) | | A | | | | | | | | | | | | |
| MHP77(L15-12) | | | K | | | | | | | | | S | | |
| MHP77(L9-1)* | | A | K | | | | | | V | | | | | |
| MHP77(L9-9) | | | | | | | | | | | | | | |
| MHP77(L9-11) | | | | | | | | | | | | | | |
| MHP77(L9-10) | | | | | | | | | | | | | | |
| MHP77(L15-02) | | A | | | | | | | | | | | | |
| MHP77(L15-08) | | | | | Q | | | | | | | | | |
| MHP77(L16-07) | | | | | | | | | | | | | | |
| MHP77(L15-35) | | | | | | | | | | | | | | |

| | 2 | 12 | 16 | 19 | 22 | 23 | 28 | 30 | 32 | 43 | 50 | 54 | 56 | 58 | 59 |
|---|---|---|---|---|---|---|---|---|---|---|---|---|---|---|---|
| | N | Y | F | G | S | I | K | E | C | F | Q | F | D | L | V |
| MHP77 | | | | | | | | | | | | | | | |
| MHP77(L13-12) | | | | | | | | | | | | | | | |
| MHP77(L13-01) | | | | | S | | | | | | | | L | | |
| MHP77(L9-05) | | | | | | | | | | | | | | | |
| MHP77(L15-42) | | | | | | | | | R | | R | | | | |
| MHP77(L15-41) | | H | | | | | | | | | | | | | A |
| MHP77(L15-36) | | | | | | | R | | | | R | | | | |
| MHP77(L15-30) | | | | A | | | | | | L | | | | | |
| MHP77(L112-03a) | | H | | A | | | | | | | | | | | |
| MHP77(L73-02a) | | | | A | | L | | | | | | | | | |
| MHP77(L13-10B1) | | | | | | | | | | | | | | L | |
| MHP77(L72-08a) | | | | | | | | | R | | R | | | L | A |
| MHP77(L72-09a) | | | | | | | R | G | | | | | | L | |
| MHP77(L72-01a) | | | | | | | | | | | | | | | |
| MHP77(L13-08a) | Q | | | | | | | | | | | | | | |
| MHP77(L13-06) | | | | | | | | | | L | | | | | |
| MHP77(L13-02) | | | | | | | | | | | | | | | |
| MHP77(L13-01a) | | | | | | | | | R | | | | | | |
| MHP77(L73-05a) | | | | | | | | | | | | | | | |
| MHP77(L15-43) | | | | | | | R | | | | | | | | |
| MHP77(L13-04) | | | | | | | | | | | | | | | |
| MHP77(L13-11) | | | | | | | | | | | | | | | |
| MHP77(L15-23) | | | | | | | | | | | | | | | |
| MHP77(L15-16) | | | | | | | | | | | | | | | |

FIG. 9G

| | 72 | 75 | 81 | 82 | 86 | 91 | 95 | 98 | 103 | 105 | 111 | 113 | 114 | 120 |
|---|---|---|---|---|---|---|---|---|---|---|---|---|---|---|
| MHP77 | S | V | I | K | N | L | L | K | N | V | Q | P | S | D |
| MHP77(L13-12) | T | A | - | - | - | - | - | - | - | - | - | - | - | - |
| MHP77(L113-01) | - | - | - | - | - | - | - | - | - | - | - | - | - | - |
| MHP77(L9-06) | - | - | - | - | - | - | - | - | - | - | - | - | - | - |
| MHP77(L15-42) | - | - | - | - | - | - | - | - | - | - | - | - | - | - |
| MHP77(L15-41) | - | - | - | R | - | - | - | - | - | - | - | - | - | - |
| MHP77(L15-36) | - | A | - | - | - | - | - | - | - | - | - | - | - | - |
| MHP77(L15-30) | T | - | - | - | - | - | - | - | - | - | - | - | - | - |
| MHP77(L112-03a) | - | - | - | - | - | - | - | - | - | A | - | - | - | - |
| MHP77(L73-02a) | - | - | - | - | - | L | - | - | - | - | - | - | - | - |
| MHP77(L13-10B1) | - | - | - | - | - | L | - | - | - | - | - | - | - | - |
| MHP77(L72-08a) | - | - | - | - | - | - | - | - | - | - | - | - | - | - |
| MHP77(L72-09a) | - | - | - | - | - | - | - | - | - | - | - | - | - | - |
| MHP77(L72-01a) | - | - | - | - | D | - | - | - | - | - | - | S | - | - |
| MHP77(L13-08a) | - | A | - | - | - | - | - | - | - | - | - | - | - | - |
| MHP77(L13-05) | - | - | - | - | - | - | - | - | - | - | R | - | - | - |
| MHP77(L13-02) | - | - | - | - | - | - | - | - | - | - | - | - | - | - |
| MHP77(L13-01a) | - | - | - | - | - | - | - | - | - | - | - | S | - | - |
| MHP77(L73-05a) | - | - | - | - | - | - | - | - | - | - | - | - | - | - |
| MHP77(L15-43) | - | - | - | - | - | - | - | - | - | - | - | - | P | - |
| MHP77(L13-04) | - | - | - | - | - | - | - | - | - | - | - | - | - | - |
| MHP77(L13-11) | - | - | - | - | - | - | - | - | - | A | - | - | - | - |
| MHP77(L15-23) | - | - | - | - | - | - | - | - | - | A | - | - | - | - |
| MHP77(L15-16) | - | - | - | - | - | - | - | - | - | - | - | - | - | - |

| | 121 | 124 | 128 | 129 | 131 | 132 | 151 | 153 | 200 | 204 | 206 | 211 | 232 | 236 | 237 |
|---|---|---|---|---|---|---|---|---|---|---|---|---|---|---|---|
| MHP77 | K | E | W | V | Q | I | V | D | L | V | G | I | V | T | Q |
| MHP77(L9-03) | G | | | | | | | | | | | | | | |
| MHP77(L15-20) | | | | | | | | | | | | | | | |
| MHP77(L15-28) | | | | | | | | | | | | | | | |
| MHP77(L15-21) | | | | | | | | | | | | | | | | |
| MHP77(L15-13) | | | | | A | | | | | | | | | | |
| MHP77(L9-04) | | R | | | | | | | | | | | | | |
| MHP77(L15-18) | | | | | | | | | | | A | | | S | L |
| MHP77(L18-01) | | | | | | | | | | | | | | | |
| MHP77(L17-12) | | | | | | | | | | | | | | | |
| MHP77(L17-01) | | R | | | | | | | | | A | | | | |
| MHP77(L15-03) | | | | | | | | | | | | | | | |
| MHP77(L15-11) | | | | | | V | | L | | | | M | | | |
| MHP77(L18-12) | | | | | | V | | L | | | | M | | | |
| MHP77(L15-15) | | | | | | V | | L | | | | | | | |
| MHP77(L15-12) | G | | | | | | | | | | | | | | |
| MHP77(L9-1)* | G | | | | | | | | | | | | | | |
| MHP77(L9-9) | G | | | | | | | | | | | | | | |
| MHP77(L9-11) | G | | | | | | | | | | | | | | |
| MHP77(L9-10) | | | | | R | | | | | | | | | | |
| MHP77(L15-02) | | | | | R | | | | | | | M | | | |
| MHP77(L15-08) | | R | | | | | | | | | | | | | |
| MHP77(L16-07) | | | | | | | | | | | | | | | |
| MHP77(L15-35) | | | | | | | | | | | | | | | |
| MHP77(L13-12) | | | | | | | | | | | | | | | |

FIG. 9K

| | 244 | 253 | 254 | 267 | 278 | 281 | 282 | 289 | 308 | 316 | 319 | 334 | 339 | 340 | 342 |
|---|---|---|---|---|---|---|---|---|---|---|---|---|---|---|---|
| MHP77 | K | Y | V | Q | L | F | L | A | K | V | I | T | L | D | L |
| MHP77(L9-03) | E | | | | | | | | | | V | | | | |
| MHP77(L15-20) | | D | | R | | | | | | | | | | | |
| MHP77(L15-28) | | | | R | | | | | | | | | | | |
| MHP77(L15-21) | | | | | | Y | | | | A | | | | | |
| MHP77(L9-04) | E | | | | | | | | | A | V | | | | |
| MHP77(L15-18) | | | | | | | | | | | | | | | |
| MHP77(L18-01) | | | | | | | | | | | | | | | |
| MHP77(L17-12) | | | | | | | | | | | | | | | |
| MHP77(L17-01) | | | I | | | | | | | | | | | | |
| MHP77(L15-03) | | | | | | | | | | | | | | | |
| MHP77(L15-11) | | | | | | | F | | | | | | | | |
| MHP77(L18-12) | | | | | I | | | | | | | | | | |
| MHP77(L15-15) | | | | | | | | | | | | | | | |
| MHP77(L15-12) | | | | | | Y | | | | A | V | | | | |
| MHP77(L9-1)* | E | | | | | | | | G | | | | | | |
| MHP77(L9-9) | E | | | | | | | | | A | | | | | |
| MHP77(L9-10) | E | | | | | | | | | A | V | | | | |
| MHP77(L15-02) | | | | R | | | | | | | | | | | |
| MHP77(L15-08) | | | | | | | | | | | | | F | G | |
| MHP77(L16-07) | | | | | | | | | | | | | | | |
| MHP77(L15-35) | | | | | | | | | | | | | | G | |
| MHP77(L13-12) | | | | | | | | | | | | | | | |

FIG. 9L

| | 121 | 124 | 128 | 129 | 131 | 132 | 151 | 153 | 200 | 204 | 206 | 211 | 232 | 236 | 237 |
|---|---|---|---|---|---|---|---|---|---|---|---|---|---|---|---|
| MHP77 | K | E | W | V | Q | I | V | D | L | V | G | I | V | T | Q |
| MHP77(L113-01) | | | | | | | | | | | | | | | |
| MHP77(9-06) | | | | | | | | | | | A | | | | |
| MHP77(L15-42) | | R | | | | | | | | | | M | | | |
| MHP77(L15-41) | | R | | | | | | | | | | M | | | |
| MHP77(L15-36) | | | | | | | | | | | | | | | |
| MHP77(L15-30) | | | | | | | | | – | | A | | | | |
| MHP77(L112-03a) | | | | | | | | | | | | | | | |
| MHP77(L73-02a) | | | | | | | | | | | | | | | S | L |
| MHP77(L13-10B1) | | | | | | | | | | | A | M | | | |
| MHP77(L72-08a) | | | | | | | | | | | | | | | |
| MHP77(L72-09a) | | | | | | | | | | | | | – | | |
| MHP77(L72-01a) | | | | | | | | | | | A | | | | |
| MHP77(L13-08a) | | | | | | | A | | | | | | | | |
| MHP77(L13-06) | | | | | | | | | | | | | | | |
| MHP77(L13-02) | | | | | | | | | | | A | | | | |
| MHP77(L13-01a) | | R | | | | | | | | | | | | | |
| MHP77(L73-05a) | | | C | | R | | | | | | | | | | |
| MHP77(L15-43) | | | | | R | V | | | | | | | | | |
| MHP77(L13-04) | | | | | | | | | | | | | | | |
| MHP77(L13-11) | | R | | | | | | | | | | | | | |
| MHP77(L15-23) | | R | | | | | | | | | | | | | |
| MHP77(L15-16) | | | | | | | | | | | | | | | |

FIG. 9M

| | 244 | 253 | 254 | 267 | 278 | 281 | 282 | 289 | 308 | 316 | 319 | 334 | 339 | 340 | 342 |
|---|---|---|---|---|---|---|---|---|---|---|---|---|---|---|---|
| | K | Y | V | Q | L | F | L | A | K | V | I | T | L | D | L |
| MHP77 | | | | | | | | | | | | | | | |
| MHP77(L113-01) | E | | | | | | | | | | | | | | |
| MHP77(L9-06) | | | | | | | | | | | V | | | | |
| MHP77(L15-42) | | | | | | | | | | | | | F | | |
| MHP77(L15-41) | | | | | | | | | | | | | | | |
| MHP77(L15-36) | | | | | | | | | | A | | | | G | |
| MHP77(L15-30) | | | | | | | | | | | | | | | |
| MHP77(L112-03a) | | | | R | | | | | | | | | | | |
| MHP77(L73-02a) | | | - | | | | | | | | | | | | |
| MHP77(L13-10B1) | | | | | | | | | G | | | | | | |
| MHP77(L72-08a) | | | | | | | | | | | | | | | |
| MHP77(L72-09a) | | | | | | | | | | | | | | | |
| MHP77(L72-01a) | | | | | | | | | | | | A | | | |
| MHP77(L13-08a) | | | | | | | | | | A | | | | | S |
| MHP77(L13-06) | | | | | | | | | | | | | | | |
| MHP77(L13-02) | | | | | I | | F | T | | | | | | | |
| MHP77(L13-01a) | | | | | | | | | | | | | | | |
| MHP77(L73-05a) | | | | | | | | | | A | | | | | |
| MHP77(L15-43) | | | | | | | | | | A | | | | | |
| MHP77(L13-04) | | | | | | | | | | | | | | | |
| MHP77(L13-11) | | | | | | | | | | | | | | | |
| MHP77(L15-23) | | | | | | | | | | | | | | | |
| MHP77(L15-16) | | | | | | | | | | | | | F | | |

| | 12 | 16 | 19 | 22 | 31 | 50 | 54 | 56 | 59 | 62 | 81 | 98 | 103 | 105 | 116 | 118 | 121 | 132 | 153 |
|---|---|---|---|---|---|---|---|---|---|---|---|---|---|---|---|---|---|---|---|
| MHP14 | Y | F | G | S | Q | Q | F | D | V | I | I | K | N | V | K | S | K | I | D |
| MHP14(L14-07) | H | - | - | - | - | - | - | - | - | - | - | - | - | - | - | - | - | T | - |
| MHP14(01) | - | - | - | - | - | - | - | - | - | - | - | - | V | - | - | - | G | V | - |
| MHP14(06) | - | - | S | - | - | R | - | L | - | - | K | - | - | - | - | - | G | - | - |
| MHP14(L14-04) | - | - | - | - | R | - | I | L | - | - | K | - | - | - | - | - | - | - | - |
| MHP14(08) | - | - | - | C | - | K | - | L | - | - | - | - | - | - | - | - | - | - | - |
| MHP14(07) | - | - | S | C | - | R | I | L | H | - | - | - | V | - | - | - | - | V | - |
| MHP14(03) | - | - | S | C | - | - | I | L | H | - | - | - | V | - | - | - | G | V | M |
| MHP14(04) | - | - | S | C | - | - | I | L | - | - | - | - | V | - | - | - | G | V | M |
| MHP14(02) | - | - | - | C | - | K | I | L | H | - | - | - | V | - | - | - | - | V | L |
| MHP14(13) | - | - | - | C | - | - | - | - | - | V | - | - | - | - | - | - | G | - | - |
| MHP14(L14-03) | - | - | - | - | - | R | - | - | - | - | - | R | - | A | R | T | - | - | M |
| MHP14(14) | - | I | - | - | - | - | - | - | - | - | - | - | - | - | - | - | - | - | - |
| MHP14(09) | - | I | S | C | - | R | - | L | - | - | - | - | V | - | - | - | G | V | M |
| MHP14(12) | - | - | - | - | - | K | - | - | - | - | - | - | V | - | - | - | - | V | M |
| MHP14(10) | - | - | - | C | - | K | - | L | - | - | K | - | V | - | - | - | - | V | L |

| | 244 K | 258 G | 281 F | 308 K | 312 V | 316 V | 319 I |
|---|---|---|---|---|---|---|---|
| MHP14 | | | | | | | |
| MHP14(L14-07) | – | – | – | – | – | – | – |
| MHP14(01) | – | – | Y | G | – | – | V |
| MHP14(06) | E | – | Y | – | – | – | V |
| MHP14(L14-04) | – | – | – | – | – | – | – |
| MHP14(08) | – | – | – | – | – | A | – |
| MHP14(07) | E | – | Y | G | – | – | V |
| MHP14(03) | E | – | Y | G | – | A | V |
| MHP14(04) | E | – | – | G | – | A | – |
| MHP14(02) | – | – | – | – | A | – | – |
| MHP14(13) | – | – | – | G | – | – | – |
| MHP14(L14-03) | E | S | Y | G | – | A | – |
| MHP14(14) | E | – | – | G | – | – | – |
| MHP14(09) | – | – | – | – | – | – | – |
| MHP14(12) | – | – | – | – | – | – | – |
| MHP14(10) | E | – | – | – | – | – | V |

FIG. 10B

| | 160 | 161 | 162 | 163 | 164 | 165 | 166 | 167 | 168 | 169 | 170 | 171 | 172 | 173 | 174 | 175 |
|---|---|---|---|---|---|---|---|---|---|---|---|---|---|---|---|---|
| MHP14 | G | G | L | S | P | S | Q | A | S | S | A | A | S | S | A | S |
| MHP14(10) | | E | V | Y | R | H | L | R | H | P | A | P | H | P | R | L | P |



| | 160 | 161 | 162 | 163 | 164 | 165 | 166 | 167 | 168 | 169 | 170 | 171 | 172 | 173 | 174 | 175 |
|---|---|---|---|---|---|---|---|---|---|---|---|---|---|---|---|---|
| MHP14 | G | G | L | S | P | S | Q | A | S | S | A | A | S | S | A | S |
| MHP14(10) | E | V | Y | R | H | L | R | H | P | A | P | H | P | R | L | P |

FIG. 10C

| | 176 | 177 | 178 | 179 | 180 | 181 | 182 | 183 | 184 | 185 | 186 | 187 | 188 | 189 | 190 | 191 | 192 |
|---|---|---|---|---|---|---|---|---|---|---|---|---|---|---|---|---|---|
| MHP14 | S | S | P | G | S | I | S | E | A | L | R | A | G | A | T | K |
| MHP14(10) | Q | A | R | V | Q | S | P | K | H | S | L | L | E | P | K | - |

FIG. 10D

| | | 24 | 32 | 50 | 54 | 56 | 57 | 80 | 105 | 124 | 129 | 131 | 153 | 185 | 211 | 241 | 253 | 292 | 311 | 316 | 318 | 340 |
|---|---|---|---|---|---|---|---|---|---|---|---|---|---|---|---|---|---|---|---|---|---|---|
| | Y | I | S | Q | F | D | K | Q | V | E | V | Q | D | A | K | F | Y | V | E | V | Q | D |
| MHP107 | | | | | | | | | | | | | | | | | | | | | | |
| MHP107(D1) | H | M | | R | | | E | | A | R | A | | L | | M | | | | R | | A | R | |
| MHP107(D5) | H | M | | R | I | L | | R | A | R | A | | L | | | | | | R | | A | R | |
| MHP107(D3) | H | M | | R | I | | | R | A | R | | | L | | | | | | | | | | |
| MHP107(D2) | | | | R | | | | | A | | | | | | | | | | | | | | |
| MHP107(C6) | | | | R | | | R | | A | | R | | L | | | | | | | | | | |
| MHP107(C4) | H | | | R | I | | | | A | A | | | L | | | | | | | | | | |
| MHP107(D4) | | | | R | | | R | | A | A | | | L | | | | | | | | | | |
| MHP107(C5) | | | | R | | | | | A | | | | | | | | | | | | | | |
| MHP107(C1) | H | | | R | | | | | A | A | | | L | T | | | H | | R | A | R | | |
| MHP107(C2) | | | | R | R | | | | | A | R | | | L | | | I | | | | | | |
| MHP107(D6) | | M | | R | R | | | | | A | | | | L | | M | I | | | | | | L |
| MHP107(C3) | | | | R | R | | | | | | | | | L | | | | | | | | | |

| | 12 Y | 50 Q | 54 F | 56 D | 57 K | 105 V | 124 E | 129 V | 131 Q | 153 D | 211 I | 237 Q | 292 V | 311 E | 316 V | 318 Q |
|---|---|---|---|---|---|---|---|---|---|---|---|---|---|---|---|---|
| ZM6.22v2 | | | | | | | | | | | | | | | | |
| ZM6.22v2(J2) | H | R | | | | | R | A | R | | M | | | R | A | R |
| ZM6.22v2(J5) | H | | | | E | A | R | | R | L | | R | | R | | |
| ZM6.22v2(J8) | H | R | I | L | | A | R | | R | | | R | | R | | |
| ZM6.22v2(J3) | | | | L | | | | | R | | | | | | | |
| ZM6.22v2(J4) | H | | | L | E | A | R | A | | | | | | | A | R |
| ZM6.22v2(J7) | H | | | | E | A | R | | | | | | | | A | R |
| ZM6.22v2(J6) | H | | | | | | | | | | | | | | | |
| ZM6.22v2(J4) | | | | | | | | | | | | | | | | |
| ZM6.22v2(J3) | H | | | | | A | R | | | | | R | | | | |
| ZM6.22v2(J5) | | | | | | | R | | | | | | | | | |
| ZM6.22v2(J2) | H | | | | E | | R | | | | | | | | A | R |
| ZM6.22v2(J9) | H | R | | | E | | R | | | | | | | R | | R |
| ZM6.22v2(J7) | | | | | | | R | A | | | | | | | A | R |
| ZM6.22v2(J8) | H | | | | | | | | | | | | | R | | |

FIG. 14A

| | 2 | 12 | 16 | 19 | 22 | 24 | 28 | 31 | 32 | 43 | 50 | 54 | 56 | 57 | 58 | 59 | 62 | 71 | 72 | 73 | 80 | 81 | 86 | 98 | 103 | 105 | 113 | 114 | 116 | 118 | 121 |
|---|---|---|---|---|---|---|---|---|---|---|---|---|---|---|---|---|---|---|---|---|---|---|---|---|---|---|---|---|---|---|---|
| LtG3-4 | N | K | F | G | S | K | K | Q | S | F | Q | F | D | K | L | V | I | G | S | V | Q | I | N | K | N | V | P | S | K | S | K |
| LtG3-4(7) | - | - | - | S | - | - | - | - | - | - | - | - | - | - | - | - | - | - | - | - | - | - | - | - | - | - | - | - | - | - | - |
| LtG3-4(15) | - | - | - | - | - | - | - | - | - | - | - | - | - | - | - | - | - | - | - | - | - | - | - | - | - | - | - | - | - | - | - |
| LtG3-4(A4) | - | - | - | - | - | - | - | - | - | - | - | - | - | - | - | - | - | - | - | - | - | - | - | - | - | - | - | - | - | - | - |
| LtG3-4(A6) | - | - | - | - | C | - | - | - | - | - | K | - | - | - | - | - | - | K | - | - | - | K | - | - | - | - | - | - | - | - | - |
| LtG3-4(B65) | - | - | - | - | - | - | - | - | - | - | R | I | L | - | - | H | - | - | - | - | - | K | - | - | V | - | - | - | - | - | G |
| LtG3-4(D5) | - | - | - | - | - | - | - | - | - | - | - | - | - | - | - | - | - | - | - | - | - | - | - | - | - | - | - | - | - | - | - |
| LtG3-4(D7) | - | - | - | - | - | - | - | - | - | - | - | - | - | - | - | - | - | - | - | - | - | - | - | - | - | - | - | - | - | - | - |
| LtG3-4(D8) | - | - | - | - | - | - | - | - | - | - | - | - | - | - | - | - | - | - | - | - | - | - | - | - | - | - | - | - | - | - | - |
| MHP77 | - | - | - | - | - | T | - | - | C | - | - | - | - | - | - | - | - | - | T | A | - | - | - | - | - | - | - | - | - | - | - |
| MHP77(L112-03a) | - | - | - | - | - | T | - | - | C | - | - | - | - | - | - | - | - | - | T | - | - | - | - | - | - | - | - | - | - | - | - |
| MHP77(L113-01) | - | - | - | - | - | T | - | - | R | - | - | - | - | - | - | - | - | - | - | - | - | - | - | - | - | - | - | - | - | - | - |
| MHP77(L113-01a) | - | - | - | - | - | T | - | - | C | - | - | - | - | - | - | - | - | - | - | - | - | - | - | - | - | - | - | - | - | - | - |
| MHP77(L113-02) | D | H | - | - | - | T | R | - | C | - | R | - | - | - | - | A | - | - | - | - | - | - | D | - | - | - | S | - | - | - | - |
| MHP77(L113-04) | - | - | - | - | - | T | - | - | C | - | - | - | - | - | - | - | - | - | - | - | - | - | - | - | - | A | - | - | - | - | - |
| MHP77(L113-08a) | - | - | - | A | - | T | - | - | R | - | - | - | - | - | - | - | - | - | - | - | - | - | - | - | - | - | - | - | - | - | - |
| MHP77(L113-1081) | - | - | - | - | - | T | - | - | C | - | R | I | - | - | - | - | - | - | - | - | - | - | - | - | - | - | - | - | - | - | - |
| MHP77(L113-11) | - | - | - | - | - | T | - | - | C | - | - | - | - | - | - | - | - | - | - | - | - | - | - | - | - | - | - | - | - | - | G |
| MHP77(L113-12) | - | - | - | - | - | T | - | - | C | - | - | - | - | - | - | - | - | - | - | - | - | - | - | - | - | - | - | - | - | - | - |
| MHP77(L72-08a) | - | - | - | - | - | T | - | - | C | - | R | I | - | - | - | - | - | - | - | - | - | K | - | - | V | - | - | - | - | - | G |
| MHP77(L9-02) | - | - | - | - | - | T | - | - | C | - | K | - | - | - | - | - | - | - | - | - | - | K | - | - | - | - | - | P | - | - | - |
| MHP77(L9-11) | - | - | - | - | - | T | - | - | C | - | - | - | - | - | - | - | - | - | - | - | - | - | - | - | - | - | - | - | - | - | - |
| MHP77(L9-12) | - | - | - | S | - | T | - | - | C | - | - | L | L | - | - | - | - | - | - | - | - | - | - | - | - | - | - | - | - | - | - |

FIG. 14B

| | 127 | 129 | 131 | 132 | 153 | 182 | 185 | 200 | 204 | 206 | 209 | 211 | 222 | 236 | 237 | 241 | 244 | 246 | 253 | 258 | 267 | 281 | 292 | 308 | 311 | 316 | 318 | 319 | 339 | 340 |
|---|---|---|---|---|---|---|---|---|---|---|---|---|---|---|---|---|---|---|---|---|---|---|---|---|---|---|---|---|---|---|
| LIG3-4 | E | V | Q | Q | D | H | A | L | V | G | S | I | F | T | Q | F | K | V | Y | G | Q | F | V | K | E | V | Q | I | L | D |
| LIG3-4(7) | - | - | - | - | - | - | G | - | - | - | - | - | - | - | - | - | - | - | - | - | - | - | - | - | - | A | - | - | - | - |
| LIG3-4(15) | - | - | - | V | - | - | - | - | - | - | - | - | - | - | - | - | - | - | - | - | - | - | - | - | - | - | - | - | - | - |
| LIG3-4(A4) | - | - | - | V | - | - | - | - | - | - | - | - | - | - | - | - | - | - | - | - | - | Y | - | - | - | - | - | - | - | - |
| LIG3-4(A6) | - | - | - | - | M | - | - | - | - | - | - | - | - | - | - | - | - | H | - | - | - | - | - | - | - | - | - | - | - | - |
| LIG3-4(B65) | - | - | - | - | L | - | - | - | - | - | - | - | - | - | - | - | - | - | - | K | - | - | - | G | - | - | - | - | - | - |
| LIG3-4(D5) | - | - | - | - | - | - | - | - | - | - | - | - | - | - | - | - | - | - | - | - | - | - | - | - | - | - | - | - | - | - |
| LIG3-4(D7) | - | - | - | - | - | - | - | - | - | - | - | - | - | - | - | - | - | - | - | - | - | - | - | - | - | - | - | - | - | - |
| LIG3-4(D8) | - | - | - | - | - | - | - | - | - | - | - | - | - | - | - | - | - | - | - | - | - | - | - | - | - | - | - | - | - | - |
| MHP77 | - | - | - | - | - | - | - | I | - | A | - | - | - | S | L | - | - | - | - | - | - | - | - | - | - | - | - | - | - | - |
| MHP77(L112-03a) | - | - | - | - | - | - | - | - | L | A | - | - | - | - | - | - | - | - | - | - | - | - | - | - | - | - | - | - | - | - |
| MHP77(L113-01) | R | - | R | - | - | - | - | - | - | - | - | - | - | - | - | - | - | - | - | - | - | - | - | - | - | - | - | - | - | - |
| MHP77(L13-02a) | - | - | - | - | - | - | - | - | - | - | - | - | - | - | - | - | - | - | - | - | - | - | - | - | - | A | - | - | - | - |
| MHP77(L13-02) | - | - | - | - | - | - | - | - | - | - | - | - | - | - | - | - | - | - | - | - | - | - | - | - | - | A | - | - | - | - |
| MHP77(L13-04) | - | - | - | - | - | - | - | - | - | - | - | M | - | - | - | - | - | - | - | - | - | - | - | - | - | - | - | - | - | - |
| MHP77(L13-06a) | - | - | - | - | - | - | - | - | - | - | - | - | - | - | - | - | - | - | - | - | - | - | - | - | - | - | - | - | - | - |
| MHP77(L13-10B1) | - | - | - | V | - | - | - | - | - | - | - | - | - | - | - | - | - | - | - | - | - | - | - | - | - | - | - | - | - | G |
| MHP77(L13-11) | - | - | - | - | - | - | - | - | - | - | - | - | - | - | - | - | - | - | - | - | - | - | - | - | - | - | - | - | - | - |
| MHP77(L13-12) | - | - | - | V | L | - | - | - | - | - | - | - | - | - | - | - | E | - | - | - | - | Y | - | - | - | A | - | - | - | - |
| MHP77(L72-06a) | - | - | - | V | L | V | - | - | - | - | - | - | - | - | - | - | - | - | - | - | - | - | - | - | - | - | - | - | - | - |
| MHP77(L9-02) | - | - | - | - | L | - | - | - | - | - | - | - | - | - | - | - | - | - | - | - | - | - | - | - | - | - | - | - | - | - |
| MHP77(L9-11) | - | - | - | - | L | - | - | - | - | - | - | - | - | - | - | - | - | - | - | - | - | Y | - | - | - | - | - | - | - | - |
| MHP77(L9-12) | - | - | - | - | L | - | - | - | - | - | - | - | - | - | - | - | - | - | - | - | - | Y | - | G | - | - | - | - | - | - |

| | 2 | 12 | 16 | 19 | 22 | 24 | 28 | 31 | 32 | 43 | 50 | 54 | 56 | 57 | 58 | 59 | 62 | 71 | 72 | 73 | 80 | 81 | 86 | 96 | 103 | 105 | 113 | 114 | 116 | 118 | 121 |
|---|---|---|---|---|---|---|---|---|---|---|---|---|---|---|---|---|---|---|---|---|---|---|---|---|---|---|---|---|---|---|---|
| MHP14 | - | - | - | - | - | I | - | - | - | - | - | - | - | - | - | - | - | - | - | - | - | - | - | - | - | - | - | - | - | - | - |
| MHP14(14-07) | - | H | - | - | - | I | - | - | - | - | - | - | - | - | - | - | V | - | - | - | - | - | - | - | - | A | - | - | - | T | - |
| MHP14(14-03) | - | - | - | - | - | I | - | - | - | - | - | - | - | - | - | - | - | - | - | - | - | - | R | - | - | A | - | - | R | - | - |
| MHP14(14-04) | - | - | - | - | - | I | - | R | - | - | - | - | - | - | - | - | - | - | - | - | - | - | - | - | - | - | - | - | - | - | - |
| MHP14(04) | - | - | - | S | - | I | - | - | - | - | R | - | - | - | - | - | - | - | - | - | - | - | - | - | V | - | - | - | - | - | - |
| MHP14(06) | - | - | - | - | - | I | - | - | - | - | R | - | L | - | - | - | - | - | - | - | - | K | - | - | - | - | - | - | - | - | G |
| MHP14(08) | - | - | I | - | C | I | - | - | - | - | R | - | L | - | - | - | - | - | - | - | - | - | - | - | - | - | - | - | - | - | G |
| MHP14(12) | - | - | - | - | - | I | - | - | - | - | R | - | L | - | - | - | - | - | - | - | - | - | - | - | V | - | - | - | - | - | - |
| MHP14(14) | - | - | - | - | - | I | - | - | - | - | R | - | - | - | - | - | - | - | - | - | - | - | - | - | - | - | - | - | - | - | - |
| MHP107 | - | - | - | - | - | I | S | - | - | - | R | - | - | - | - | - | - | - | - | - | - | - | - | - | - | A | - | - | - | - | - |
| MHP107(C1) | - | - | - | - | - | I | S | - | - | - | R | - | - | E | - | - | - | - | - | - | - | - | - | - | - | A | - | - | - | - | - |
| MHP107(C5) | - | - | - | - | - | I | S | - | - | - | R | - | - | - | - | - | - | - | - | - | - | - | - | - | - | A | - | - | - | - | - |
| MHP107(C6) | - | - | - | - | - | I | S | - | - | - | R | - | - | - | - | - | - | - | - | - | R | - | - | - | - | A | - | - | - | - | - |
| MHP107(D3) | - | - | - | - | - | M | S | - | - | - | R | - | - | - | - | - | - | - | - | - | - | - | - | - | - | A | - | - | - | - | - |
| MHP107(D4) | H | - | - | - | - | I | S | - | - | - | R | - | - | - | - | - | - | - | - | - | - | - | - | - | - | A | - | - | - | - | - |
| MHP107(D5) | H | - | - | - | - | M | S | - | - | - | R | - | - | E | - | - | - | - | - | - | - | - | - | - | - | A | - | - | - | - | - |

FIG. 14C

| | 124 | 129 | 131 | 132 | 153 | 182 | 185 | 200 | 204 | 206 | 209 | 211 | 222 | 236 | 237 | 241 | 244 | 246 | 253 | 258 | 267 | 281 | 292 | 308 | 311 | 316 | 318 | 319 | 339 | 340 |
|---|---|---|---|---|---|---|---|---|---|---|---|---|---|---|---|---|---|---|---|---|---|---|---|---|---|---|---|---|---|---|
| MHP14 | - | - | - | - | - | - | - | - | - | - | - | - | - | - | - | - | - | - | - | - | - | - | - | - | - | - | - | - | - | - |
| MHP14(L14-07) | - | - | - | T | - | - | - | - | - | - | - | - | - | - | - | - | - | - | - | - | - | - | - | - | - | - | - | - | - | - |
| MHP14(L14-03) | - | - | - | - | M | - | - | - | - | - | - | - | - | - | - | - | - | - | - | - | - | - | - | - | - | - | - | - | - | - |
| MHP14(L14-04) | - | - | - | V | - | - | - | - | - | - | - | - | - | - | - | - | - | - | - | - | - | - | - | - | - | A | - | A | - | - |
| MHP14(04) | - | - | - | - | M | - | - | - | - | - | - | - | - | - | - | - | E | - | - | - | - | Y | - | G | - | - | - | - | - | - |
| MHP14(06) | - | - | - | - | - | - | - | - | - | - | - | - | - | - | - | - | - | - | - | - | - | - | - | - | - | A | - | A | - | - |
| MHP14(08) | - | - | - | - | - | - | - | - | - | - | - | - | - | - | - | - | E | - | - | S | - | Y | - | G | - | - | - | - | - | - |
| MHP14(12) | - | - | - | V | M | - | - | - | - | - | - | - | - | - | - | - | - | - | - | - | - | - | - | - | - | A | - | - | - | - |
| MHP14(14) | - | - | - | - | - | - | - | - | - | - | - | - | - | - | - | - | - | - | - | - | - | - | - | - | - | - | - | - | - | - |
| MHP107 | - | - | - | - | - | - | - | - | - | - | - | K | - | - | - | - | - | - | - | - | - | - | - | - | - | A | R | - | - | - |
| MHP107(C1) | R | - | - | - | L | - | T | - | - | - | - | K | - | - | - | I | - | - | H | - | - | - | - | - | - | - | - | - | - | - |
| MHP107(C5) | - | - | - | - | - | - | - | - | - | - | - | K | - | - | - | - | - | - | - | - | - | - | - | - | - | - | - | - | - | - |
| MHP107(C6) | - | - | - | - | - | - | - | - | - | - | - | K | - | - | - | I | - | - | - | - | - | - | - | - | - | - | - | - | - | - |
| MHP107(D3) | R | A | - | - | L | - | - | - | - | - | - | K | - | - | - | - | - | - | - | - | - | - | A | - | - | A | R | - | - | - |
| MHP107(D4) | - | A | - | - | L | - | - | - | - | - | - | K | - | - | - | - | - | - | - | - | - | - | - | - | - | - | - | - | - | - |
| MHP107(D5) | R | A | - | - | L | - | - | - | - | - | - | K | - | - | - | - | - | - | - | - | - | - | A | - | R | - | - | - | - | - |

| | 2 N | 12 Y | 16 F | 19 G | 22 S | 24 K | 28 K | 31 Q | 32 S | 43 F | 50 Q | 54 F | 56 D | 57 K | 58 L | 59 V | 62 I | 71 G | 72 S | 73 V | 80 Q | 81 I | 86 N | 96 K | 103 N | 105 V | 113 P | 114 S | 116 K | 118 S |
|---|---|---|---|---|---|---|---|---|---|---|---|---|---|---|---|---|---|---|---|---|---|---|---|---|---|---|---|---|---|---|
| LIG3-4 | | | | | | | | | | | | | | | | | | | | | | | | | | | | | | |
| ZM6.22v2 | | | | | | | | | | | | | | | | | | | | | E | | | | | | | | | |
| Zm6.22v2(I2) | | H | | | | | | | | | R | | | | | | | | | | E | | | | | V | | | | |
| Zm6.22v2(I3) | | H | | | | | | | | | | | | | | | | | | | E | | | | | | | | | |
| Zm6.22v2(I4) | | | | | | | | | | | | | | | | | | | | | E | | | | | | | | | |
| Zm6.22v2(I6) | | H | | | | | | | | | R | | | E | | | | | | | E | | | | | A | | | | |
| Zm6.22v2(I7) | | H | | | | | | | | | | | L | E | | | | | | | E | | | | | | | | | |
| Zm6.22v2(I8) | | H | | | | | | | | | | | | E | | | | | | | E | | | | | | | | | |
| Zm6.22v2(I9) | | H | | | | | | | | | | | | | | | | | | | E | | | | | | | | | |
| Zm6.22v2(J2) | | | | | | | | | | | R | | | | | | | | | | E | | | | | A | | | | |
| Zm6.22v2(J3) | | H | | | | | | | | | | | L | | | | | | | | E | | | | | A | | | | |
| Zm6.22v2(J4) | | H | | | | | | | | | R | | | | | | | | | | E | | | | | A | | | | |
| Zm6.22v2(J5) | | H | | | | | | | | | | | | | | | | | | | E | | | | | | | | | |
| Zm6.22v2(J7) | | H | | | | | | | | | | | L | E | | | | | | | E | | | | | | | | | |
| Zm6.22v2(J8) | | H | | | | | | | | | | | | | | | | | | | | | | | | | | | | |
| ZM6.3resynthesis | | | | | | | | | | | | | | | | | | | | | R | | | | | | | | | |
| Zm6.3(G1) | | | | | | | | | R | | R | | | | | | | | | | | | | | | | | | | |
| Zm6.3(G2) | | H | | | | | | | R | | R | | | | | | | | | | | | | | | | | | | |
| Zm6.3(G3) | | H | | | | | | | | | | | L | | | | | | | | | | | | | A | | | | |
| Zm6.3(G4) | | | | | | M | | | R | | R | | | | | | | | | | | | | | | | | | | |
| Zm6.3(G6) | | H | | | | | | | | | | | | E | | | | | | | | | | | | A | | | | |
| Zm6.3(H1) | | H | | | | | | | | | R | | L | | | | | | | | | | | | | | | | | |
| Zm6.3(H2) | | H | | | | | | | R | | | | | | | | | | | | | | | | | | | | | |
| Zm6.3(H3) | | H | | | | | | | | | | | | | | | | | | | | | | | | A | | | | |
| Zm6.3(H5) | | H | | | | | | | | | | | L | | | | | | | | | | | | | | | | | |
| Zm6.3(H6) | | H | | | | | | | R | | | | | | | | | | | | | | | | | A | | | | |

Alignment of linker region (shown in gray)

| Name | SEQ ID NO | 154 | 155 | 156 | 157 | 158 | 159 | 160 | 161 | 162 | 163 | 164 |
|---|---|---|---|---|---|---|---|---|---|---|---|---|
| MHP14 | 282 | S | L | P | G | S | V | G | G | L | S | P |
| MHP14(L9-01) | 292 | S | L | P | G | S | V | E | V | Y | R | H |
| MHP77 | 86 | S | L | P | G | S | V | G | G | L | S | P |
| MHP77(L9-01) | 92 | S | L | P | G | S | W | E | V | Y | R | H |

FIG. 15B

Alignment of linker region (shown in gray)

| Name | SEQ ID NO | 165 | 166 | 167 | 168 | 169 | 170 | 171 | 172 | 173 | 174 | 175 | 176 |
|---|---|---|---|---|---|---|---|---|---|---|---|---|---|
| MHP14 | 282 | S | Q | A | S | S | A | S | S | A | S | S | S |
| MHP14(L9-01) | 292 | L | R | H | P | A | P | H | P | R | L | P | Q |
| MHP77 | 86 | S | Q | A | S | S | A | S | S | A | S | S | S |
| MHP77(L9-01) | 92 | L | R | H | P | A | P | H | P | R | L | P | Q |

Alignment of linker region (shown in gray)

| Name | SEQ ID NO | 177 | 178 | 179 | 180 | 181 | 182 | 183 | 184 | 185 | 186 | 187 |
|---|---|---|---|---|---|---|---|---|---|---|---|---|
| MHP14 | 282 | S | P | G | S | G | I | S | E | A | L | R |
| MHP14(10) | 292 | A | R | V | Q | G | S | P | K | H | S | E |
| MHP77 | 86 | S | P | G | S | G | I | S | E | A | L | R |
| MHP77(L9-01) | 92 | A | R | V | Q | G | S | P | K | H | S | E |

FIG. 15C

Alignment of linker region (shown in gray)

| Name | SEQ ID NO | 188 | 189 | 190 | 191 | 192 | 193 | 194 | 195 | 196 | 197 | 198 | 199 |
|---|---|---|---|---|---|---|---|---|---|---|---|---|---|
| MHP14 | 282 | A | G | A | T | K | S | K | E | F | L | L | Y |
| MHP14(10) | 292 | L | E | P | K | - | S | K | E | F | L | L | Y |
| MHP77 | 86 | A | G | A | T | K | S | K | E | F | L | L | Y |
| MHP77(L9-01) | 92 | L | E | Q | L | - | S | P | K | S | F | L | Y |

FIG. 15D

Percent identity of variant meganucleases

| Percent identity | 1 | 2 | 3 | 4 | 5 | | |
|---|---|---|---|---|---|---|---|
| 1 | ■ | 95.4 | 83.4 | 94.9 | 80.8 | 1 | LIG3-4.pro SEQ ID NO: 1 |
| 2 | 4.7 | ■ | 88.0 | 96.6 | 82.5 | 2 | MHP14.pro SEQ ID NO: 282 |
| 3 | 18.1 | 12.5 | ■ | 84.5 | 92.0 | 3 | MHP14(10).pro SEQ ID NO: 292 |
| 4 | 5.3 | 3.5 | 16.7 | ■ | 86.0 | 4 | MHP77.pro SEQ ID NO: 86 |
| 5 | 21.8 | 19.6 | 8.5 | 15.2 | ■ | 5 | MHP77(L9-01).pro SEQ ID NO: 92 |
|   | 1 | 2 | 3 | 4 | 5 |   |   |

FIG. 15E

COMPOSITIONS AND METHODS COMPRISING SEQUENCES HAVING MEGANUCLEASE ACTIVITY

This application claims the benefit of U.S. Provisional Application No. 61/642,470, filed May, 04, 2012 and U.S. Provisional Application No. 61/683,765, filed Aug. 16, 2012; both of which are hereby incorporated herein in their entirety by reference.

REFERENCE TO SEQUENCE LISTING SUBMITTED ELECTRONICALLY

The official copy of the sequence listing is submitted electronically via EFS-Web as an ASCII formatted sequence listing with a file named "20140327_BB2117USNP_SubstituteSequenceListing_ST25" created on Mar. 24, 2014, and having a size of 954 kilobytes. The sequence listing contained in this ASCII formatted document is part of the specification and is herein incorporated by reference in its entirety.

FIELD OF THE INVENTION

This invention is in the field of molecular biology. More specifically, this invention pertains to sequences having meganuclease activity.

BACKGROUND OF THE INVENTION

Recombinant DNA technology has made it possible to insert foreign DNA sequences into the genome of an organism, thus, altering the organism's phenotype. The most commonly used plant transformation methods are *Agrobacterium* infection and biolistic particle bombardment in which transgenes integrate into a plant genome in a random fashion and in an unpredictable copy number. Thus, efforts are undertaken to control transgene integration in plants.

Site-specific integration techniques, which employ site-specific recombination systems, as well as, other types of recombination technologies, have been used to generate targeted insertions of genes of interest in a variety of organism.

Other methods for inserting or modifying a DNA sequence involve homologous DNA recombination by introducing a transgenic DNA sequence flanked by sequences homologous to the genomic target. U.S. Pat. No. 5,527,695 describes transforming eukaryotic cells with DNA sequences that are targeted to a predetermined sequence of the eukaryote's DNA. Transformed cells are identified through use of a selectable marker included as a part of the introduced DNA sequences.

While both systems have provided useful techniques for targeted insertion of sequences of interest, there remains a need for nucleases that will facilitate precise modification of a plant or yeast genome. In addition, there remains a need for meganucleases with increased activity that can introduce a double strand brake at a wide range of temperatures.

BRIEF SUMMARY OF THE INVENTION

Compositions and methods comprising polynucleotides and polypeptides having meganuclease activity are provided. Further provided are compositions comprising polynucleotides encoding variant meganucleases comprising at least one amino acid modification, wherein the variant meganuclease has increased activity. Also provided are nucleic acid constructs, yeast, plants, plant cells, explants, seeds and grain having the meganuclease sequences.

Various methods of employing the meganuclease sequences are provided. Such methods include methods for increasing meganuclease activity in a cell, yeast cell, plant cell, plant, explant or seed. Further provided are methods and compositions that allow the various meganuclease polypeptides and variants and fragments thereof to be expressed in a yeast or plant cell at a wide range of temperatures. Such methods and compositions find use in producing yeast, plant cells, plants and explants with improved meganuclease activity.

Thus in a first embodiment, the invention concerns an isolated or recombinant polynucleotide comprising a nucleotide sequence encoding a meganuclease polypeptide, said polypeptide comprising: a) an amino acid sequence having at least one amino acid modification at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; or, b) an amino acid sequence having at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 or 44 of any of the amino acid modification of (a).

In other embodiments, the invention concerns an isolated or recombinant polynucleotide of the present disclosure, wherein said nucleotide sequence encodes a meganuclease polypeptide having at least 80%, 81, %, 82%, 83%, 84%, 85%, 86%, 87%, 88%, 89%, 90%, 91%, 92%, 93%, 94%, 95%, 96%, 97%, 98%, 99% sequence identity to SEQ ID NO: 1.

In another embodiment, the invention concerns the isolated or recombinant polynucleotide of embodiment 1, and its corresponding polypeptide, wherein said at least one amino acid modification comprises; a) an aspartic acid (D) at a position corresponding to amino acid position 2 in SEQ ID NO: 1; b) a histidine (H) at a position corresponding to amino acid position 12 in SEQ ID NO: 1; c) an isoleucine (I) at a position corresponding to amino acid position 16 in SEQ ID NO: 1; d) a cysteine (C) at a position corresponding to amino acid position 22 in SEQ ID NO: 1; e) a leucine (L) at a position corresponding to amino acid position 23 in SEQ ID NO: 1; f) an arginine (R) at a position corresponding to amino acid position 31 in SEQ ID NO: 1; g) an asparagine (N) at a position corresponding to amino acid position 36 in SEQ ID NO: 1; h) a leucine (L) at a position corresponding to amino acid position 43 in SEQ ID NO: 1; i) an arginine (R) or lysine (K) at a position corresponding to amino acid position 50 in SEQ ID NO: 1; j) a leucine (L) at a position corresponding to amino acid position 56 in SEQ ID NO: 1; k) an isoleucine (I) at a position corresponding to amino acid position 58 in SEQ ID NO: 1; l) a histidine (H) or alanine (A) at a position corresponding to amino acid position 59 in SEQ ID NO: 1; m) a valine (V) at a position corresponding to amino acid position 62 in SEQ ID NO: 1; n) a lysine (K) at a position corresponding to amino acid position 71 in SEQ ID NO: 1; o) a threonine (T) at a position corresponding to amino acid position 72 in SEQ ID NO: 1; p) an alanine (A) at a position corresponding to amino acid position 73 in SEQ ID NO: 1; q) an arginine (R) at a position corresponding to amino acid position 80 in SEQ ID NO: 1; r) a lysine (K) at a position corresponding to amino acid position 81 in SEQ ID NO: 1; s) an arginine (R) at a position corresponding to amino acid position 82 in SEQ ID NO: 1; t) an aspartic acid (D) at a position corresponding to amino acid position 86 in SEQ ID NO: 1; u) an isoleucine (I) at a position corresponding to amino acid position 91 in SEQ ID NO: 1; v) an isoleucine (I) at a position corresponding to amino acid position 95 in SEQ ID NO: 1; w) an arginine (R) at a position corresponding to amino acid position 98 in SEQ ID NO: 1; x) a valine (V) at a position corresponding to amino acid position 103 in SEQ ID NO: 1; y) a serine (S) at a position corresponding to amino acid position 113 in SEQ ID NO: 1; z) a proline (P) at a position corresponding to amino acid position 114 in SEQ ID NO: 1; aa) an arginine (R) at a position corresponding to amino acid position 116 in SEQ ID NO: 1; bb) a glycine (G) at a position corresponding to amino acid position 117 in SEQ ID NO: 1; cc) a threonine (T) at a position corresponding to amino acid position 118 in SEQ ID NO: 1; dd) an glycine (G) at a position corresponding to amino acid position 121 in SEQ ID NO: 1; ee) an arginine (R) at a position corresponding to amino acid position 124 in SEQ ID NO: 1; ff) a cysteine (C) at a position corresponding to amino acid position 128 in SEQ ID NO: 1; gg) an alanine (A) at a position corresponding to amino acid position 129 in SEQ ID NO: 1; hh) an arginine (R) at a position corresponding to amino acid position 131 in SEQ ID NO: 1; ii) a serine (S) at a position corresponding to amino acid position 147 in SEQ ID NO: 1; jj) an alanine (A) at a position corresponding to amino acid position 151 in SEQ ID NO: 1; kk) a leucine (L) or a methionine (M) at a position corresponding to amino acid position 153 in SEQ ID NO: 1; ll) a tryptophan (W) at a position corresponding to amino acid position 159 in SEQ ID NO: 1; mm) a glutamic acid (E) at a position corresponding to amino acid position 160 in SEQ ID NO: 1; nn) a valine (V) at a position corresponding to amino acid position 161 in SEQ ID NO: 1; oo) a tyrosine (Y) at a position corresponding to amino acid position 162 in SEQ ID NO: 1; pp) an arginine (R) at a position corresponding to amino acid position 163 in SEQ ID NO: 1; qq) a histidine (H) at a position corresponding to amino acid position 164 in SEQ ID NO: 1; rr) a leucine (L) at a position corresponding to amino acid position 165 in SEQ ID NO: 1; ss) an arginine (R) at a position corresponding to amino acid position 166 in SEQ ID NO: 1; tt) a histidine (H) at a position corresponding to amino acid position 167 in SEQ ID NO: 1; uu) a proline (P) at a position corresponding to amino acid position 168 in SEQ ID NO: 1; vv) an alanine (A) at a position corresponding to amino acid position 169 in SEQ ID NO: 1; ww) a proline (P) at a position corresponding to amino acid position 170 in SEQ ID NO: 1; xx) a histidine (H) at a position corresponding to amino acid position 171 in SEQ ID NO: 1; yy) a proline (P) at a position corresponding to amino acid position 172 in SEQ ID NO: 1; zz) an arginine (R) at a position corresponding to amino acid position 173 in SEQ ID NO: 1; aaa) a leucine (L) at a position corresponding to amino acid position 174 in SEQ ID NO: 1; bbb) a proline (P) at a position corresponding to amino acid position 175 in SEQ ID NO: 1; ccc) a glutamine (Q) at a position corresponding to amino acid position 176 in SEQ ID NO: 1; ddd) an alanine (A) at a position corresponding to amino acid position 177 in SEQ ID NO: 1; eee) an arginine (R) at a position corresponding to amino acid position 178 in SEQ ID NO: 1; fff) a valine (V) at a position corresponding to amino acid position 179 in SEQ ID NO: 1; ggg) a glutamine (Q) at a position corresponding to amino acid position 180 in SEQ ID NO: 1; hhh) a valine (V) at a position corresponding to amino acid position 182 in SEQ ID NO: 1; iii) a proline (P) at a position corresponding to amino acid position 183 in SEQ ID NO: 1; jjj) a lysine (K) at a position corresponding to amino acid position 184 in SEQ ID NO: 1; kkk) a threonine (T) or a histidine (H) at a position corresponding to amino acid position 185 in SEQ ID NO: 1; lll) a serine (S) at a position corresponding to amino acid position 186 in SEQ ID NO: 1; mmm) a glutamic acid (E) at a position corresponding to amino acid position 187 in SEQ ID NO: 1; nnn) a leucine (L) at a position corresponding to amino acid position 188 in SEQ ID NO: 1; ooo) a glutamic acid (E) at a position corresponding to amino acid position 189 in SEQ ID NO: 1; ppp) a glutamine (Q) at a position corresponding to amino acid position 190 in SEQ ID NO: 1; qqq) a leucine (L) at a position corresponding to amino acid position 191 in SEQ ID NO: 1; rrr) a proline (P) at a position corresponding to amino acid position 194 in SEQ ID NO: 1; sss) a lysine (K) at a position corresponding to amino acid position 195 in SEQ ID NO: 1; ttt) a serine (S) at a position corresponding to amino acid position 196 in SEQ ID NO: 1; uuu) a phenylalanine (F) at a position corresponding to amino acid position 197 in SEQ ID NO: 1; vvv) an isoleucine (I) at a position corresponding to amino acid position 200 in SEQ ID NO: 1; www) a valine (V) at a position corresponding to amino acid position 203 in SEQ ID NO: 1; xxx) a leucine (L) at a position corresponding to amino acid position 204 in SEQ ID NO: 1; yyy) a cysteine (C) at a position corresponding to amino acid position 209 in SEQ ID NO: 1; zzz) a leucine (L) at a position corresponding to amino acid position 222 in SEQ ID NO: 1; aaaa) an isoleucine (I) at a position corresponding to amino acid position 232 in SEQ ID NO: 1; bbbb) a serine (S) at a position corresponding to amino acid position 236 in SEQ ID NO: 1; cccc) a leucine (L) or an arginine (R) at a position corresponding to amino acid position 237 in SEQ ID NO: 1; dddd) a histidine (H) at a position corresponding to amino acid position 246 in SEQ ID NO: 1; eeee) an isoleucine (I) at a position corresponding to amino acid position 254 in SEQ ID NO: 1; ffff) a serine (S) at a position corresponding to amino acid position 258 in SEQ ID NO: 1; gggg) an arginine (R) at a position corresponding to amino acid position 267 in SEQ ID NO: 1; hhhh) an isoleucine (I) at a position corresponding to amino acid position 278 in SEQ ID NO: 1; iiii) a tyrosine (Y) at a position corresponding to amino acid position 281 in SEQ ID NO: 1; jjjj) a phenylalanine (F) at a position corresponding to amino acid position 282 in SEQ ID NO: 1; kkkk) a threonine (T) at a position corresponding to amino acid position 289 in SEQ ID NO: 1; llll) a glycine (G) at a position corresponding to amino acid position 308 in SEQ ID NO: 1; mmmm) an arginine (R) at a position corresponding to amino acid position 311 in SEQ ID NO: 1; nnnn) an alanine (A) at a position corresponding to amino acid position 312 in SEQ ID NO: 1; oooo) an alanine (A) at a position corresponding to amino acid position 316 in SEQ ID NO: 1; pppp) an arginine (R) at a position corresponding to amino acid position 318 in SEQ ID NO: 1 qqqq) an alanine (A) at a position corresponding to amino acid position 334 in SEQ ID NO: 1; rrrr) a phenylalanine (F) at a position corresponding to amino acid position 339 in SEQ ID NO: 1; ssss) a glycine (G) or a leucine (L) at a position corresponding to amino acid position 340 in SEQ ID NO: 1; tttt) a serine (S) at a position corresponding to amino acid position 342 in SEQ ID NO: 1; uuuu) an asparagine (N) at a position corresponding to amino acid position 345 in SEQ ID NO: 1;

vvvv) an asparagine (N) at a position corresponding to amino acid position 346 in SEQ ID NO: 1; wwww) an asparagine (N) at a position corresponding to amino acid position 348 in SEQ ID NO: 1; or, xxxx) any combination of a) to wwww).

In another embodiment, the invention concerns the isolated or recombinant polynucleotide of embodiment 1, and its corresponding polypeptide, wherein said nucleotide sequence encodes a meganuclease polypeptide, wherein said polypeptide further comprises at least one amino acid modification described herein such as those shown in FIG. 5A-FIG. 5E, FIG. 9A-FIG. 9N, FIG. 10A-FIG. 10D, FIG. 11, FIG. 12, FIG. 13, FIG. 14A-FIG. 14F and FIG. 15A-FIG. 15E as well any I-CreI type modification known and any combination thereof.

In another embodiment, the invention concerns an isolated or recombinant polynucleotide, and its corresponding polypeptide, wherein said nucleotide sequence encodes a meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402, 403, 430, 431, 432 and 433.

In another embodiment, the invention concerns an isolated or recombinant polynucleotide of the present disclosure, and its corresponding polypeptide, wherein said nucleotide sequence encodes a meganuclease polypeptide, wherein the polypeptide is capable of recognizing and cleaving a meganuclease recognition sequence selected from the group consisting of SEQ ID NO: 2, SEQ ID NO: 85, SEQ ID NO:269, SEQ ID NO:281, SEQ ID NO: 331, SEQ ID NO:358, SEQ ID NO:390, SEQ ID NO:423 or SEQ ID NO:424.

In another embodiment, the invention concerns an isolated or recombinant polynucleotide of the present disclosure, and its corresponding polypeptide, wherein said nucleotide sequence encodes a meganuclease polypeptide, wherein said polypeptide has an increased meganuclease activity when compared to a control meganuclease that lacks said amino acid modification. The control meganuclease can be selected from the group of SEQ ID NO:1, SEQ ID NO: 86, SEQ ID NO: 250, SEQ ID NO:270, SEQ ID NO:271, SEQ ID NO:282, SEQ ID NO:283, SEQ ID NO: 329, SEQ ID NO:356, SEQ ID NO:389, SEQ ID NO:429 or SEQ ID NO:435 or any I-CreI type meganuclease. Increased meganuclease activity can be evidenced by any method for measuring meganuclease activity, including but not limited to a) a higher yeast assay score when compared to the control meganuclease that lacks said amino acid modification; or, b) a higher target site mutation rate when compared to the control meganuclease that lacks said amino acid modification; or, c) a higher in-vitro cutting when compared to the control meganuclease that lacks said amino acid modification; or, d) any combination of those methods. Furthermore, increased activity can be measured at a wide range of temperatures such as temperatures including 16° C., 24° C., 28° C., 30° C. or 37° C. and temperatures between 16° C. to 37° C.

In another embodiment, the invention concerns an isolated or recombinant polynucleotide, further comprising a nucleotide sequence encoding a N-terminal nuclear transit peptide and/or a nucleotide sequence encoding a C-terminal histidine tag.

In another embodiment, the invention concerns a recombinant DNA construct, comprising the isolated or recombinant polynucleotide of the present disclosure. The recombinant DNA construct can further comprise a promoter operably linked to said polynucleotide. The promoter can be heterologous with respect to the recombinant polynucleotide.

In another embodiment, the invention concerns a cell, plant cell, yeast cell, plant, yeast or seed comprising the recombinant construct of the present disclosure. The plant cell can be a monocot or a dicot plant cell. The monocot plant cell can be from maize, wheat, rice, barley, sugarcane, sorghum, or rye. The dicot cell can be a from soybean, *Brassica*, sunflower, cotton, or alfalfa.

In another embodiment, the invention concerns plants comprising the recombinant construct of the present disclosure and seeds or plant extracts, explant obtained from such plants.

In another embodiment, the invention concerns a method for producing a meganuclease having increased activity over a range of temperatures, the method comprising:
  a) producing a variant meganuclease by modifying at least one amino acid at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346 348 and combinations thereof; and,
  b) selecting said variant meganuclease from step a) and screening said variant meganuclease for the ability to cleave a DNA target sequence over a range of temperatures between and including 16° C. to 37° C.

In another embodiment, the invention concerns a method for producing a meganuclease having an increased meganuclease activity when compared to a control meganuclease, the method comprising:
  a) producing a variant meganuclease by modifying at least one amino acid at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; and,
  b) selecting the variant meganuclease from step a) and screening said variant for increased meganuclease activity when compared to a control meganuclease.

In another embodiment, the invention concerns a method of introducing a double-strand break in the genome of a yeast or plant cell, said method comprising:

a) contacting at least one plant or yeast cell comprising in its genome a meganuclease recognition site with a variant meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402 and 403, wherein the variant meganuclease is capable of inducing a double-strand break in said recognition site; and, b) selecting the yeast or plant cell from a) and screening said yeast or plant cell for any modification of said recognition sequence.

In another embodiment, the invention concerns a method of integrating a polynucleotide of interest into a recognition site in the genome of a plant or yeast cell, the method comprising:

a) contacting at least one plant or yeast cell comprising in its genome a meganuclease recognition site with:
(i) a variant meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402 and 403,
wherein the variant meganuclease is capable of inducing a double-strand break in said recognition site; and,
(ii) a DNA fragment containing a polynucleotide of interest;

b) selecting at least one plant or yeast cell comprising integration of the polynucleotide of interest cassette at the recognition site.

In another embodiment, the invention concerns an isolated or recombinant polynucleotide, and its corresponding polypeptide, encoding a meganuclease polypeptide, said polypeptide comprising an amino acid sequence having at least one amino acid modification at an amino acid position corresponding to a position of SEQ ID NO:1 selected from the group consisting of positions 16, 22, 50, 56, 59, 71, 81, 103, 121, 153, 185, 209, 222, 246, 258, 281, 308, 316, 345, 346, and combinations thereof, and wherein the polypeptide is capable of recognizing and cleaving a meganuclease target site comprising SEQ ID NO: 2.

In another embodiment, the invention concerns an isolated or recombinant polynucleotide encoding a meganuclease polypeptide, the polypeptide comprising an amino acid sequence having at least one amino acid modification at an amino acid position corresponding to a position of SEQ ID NO:86 selected from the group consisting of positions 2, 12, 16, 22, 23, 36, 43, 50, 56, 58, 59, 72, 73, 81, 86, 91, 95, 103, 113, 114, 120, 121, 124, 128, 129, 131, 151, 153, 200, 204, 209, 232, 236, 237, 246, 254, 258, 267, 281, 308, 311, 312, 316, 319, 334, 339, 340, 342, and combinations thereof, and wherein the polypeptide is capable of recognizing and cleaving a meganuclease target site comprising SEQ ID NO: 85.

In another embodiment, the invention concerns an isolated or recombinant polynucleotide encoding a meganuclease polypeptide, the polypeptide comprising an amino acid sequence having at least one amino acid modification at an amino acid position corresponding to a position of SEQ ID NO:270 selected from the group consisting of positions 16, 22, 50, 71, 185, 246, 258, 316 and combinations thereof, and wherein the polypeptide is capable of recognizing and cleaving a meganuclease target site comprising SEQ ID NO: 269.

In another embodiment, the invention concerns an isolated or recombinant polynucleotide encoding a meganuclease polypeptide, the polypeptide comprising an amino acid sequence having at least one amino acid modification at an amino acid position corresponding to a position of SEQ ID NO:329 selected from the group consisting of positions 12, 32, 50, 56, 80, 105, 124, 129, 131, 153, 185, 311, 316, 318, 340, and combinations thereof, and wherein the polypeptide is capable of recognizing and cleaving a meganuclease target site comprising SEQ ID NO: 328.

In another embodiment, the invention concerns an isolated or recombinant polynucleotide encoding a meganuclease polypeptide, the polypeptide comprising an amino acid sequence having at least one amino acid modification at an amino acid position corresponding to a position of SEQ ID NO:356 selected from the group consisting of positions 12, 24, 36, 50, 56, 62, 73, 80, 124, 129, 147, 182, 203, 237, 252, 311, 316, 318, 340, 348, and combinations thereof, and wherein the polypeptide is capable of recognizing and cleaving a meganuclease target site comprising SEQ ID NO: 355.

In another embodiment, the invention concerns an isolated or recombinant polynucleotide encoding a meganuclease polypeptide, the polypeptide comprising an amino acid sequence having at least one amino acid modification at an amino acid position corresponding to a position of SEQ ID NO:389 selected from the group consisting of positions 12, 50, 56, 124, 129, 131, 153, 211, 237, 311, 316, and position 318, and combinations thereof, and wherein the polypeptide is capable of recognizing and cleaving a meganuclease target site comprising SEQ ID NO: 388.

In another embodiment, the invention concerns An isolated or recombinant polynucleotide encoding a meganuclease polypeptide, the polypeptide comprising an amino acid sequence having at least one amino acid modification at an amino acid position corresponding to a position of SEQ ID NO:429 selected from the group consisting of positions 16, 22, 50, 71, 185, 246, 258, 316 and combinations thereof, and wherein the polypeptide is capable of recognizing and cleaving a meganuclease target site comprising SEQ ID NO: 423.

BRIEF DESCRIPTION OF THE DRAWINGS AND SEQUENCE LISTING

The invention can be more fully understood from the following detailed description and the accompanying drawings and Sequence Listing, which form a part of this application. The sequence descriptions and sequence listing attached hereto comply with the rules governing nucleotide and amino acid sequence disclosures in patent applications as set forth in 37 C.F.R. §§1.821 1.825. The sequence descriptions contain the three letter codes for amino acids as defined in 37 C.F.R. §§1.821 1.825, which are incorporated herein by reference.

FIG. 1A-FIG. 1B show an amino acid alignment of I-CreI meganuclease (1-CreI.pro, SEQ ID NO: 3) with related meganucleases (SEQ ID NOs: 4-13) from various species. The decoration shows amino acid residues sharing identity.

FIG. 2 shows a diagram representing the yeast screening system used to determine the meganuclease activity in yeast. Gene fragments corresponding to the first 1000 nucleotides of the yeast Ade2 coding sequence (Ade2 5' fragment) and the last 1011 nucleotides of the yeast Ade2 coding sequence (Ade2 3' fragment) were disrupted by a fragment including the yeast ura3 gene (Ura3) and meganuclease recognition sites for I-SceI.

FIG. 3 shows the numerical scale and corresponding white sectoring of yeast colonies used to quantify meganuclease activity. Since the sectoring phenotype is a qualitative measure of meganuclease activity, a 0-4 numerical scoring system was implemented. A score of 0 indicates that no white sectors (no meganuclease cutting) were observed; a score of 4 indicates completely white colonies (complete cutting of the recognition site); scores of 1-3 indicate intermediate white sectoring phenotypes (and intermediate degrees of recognition site cutting).

Figure 5B:
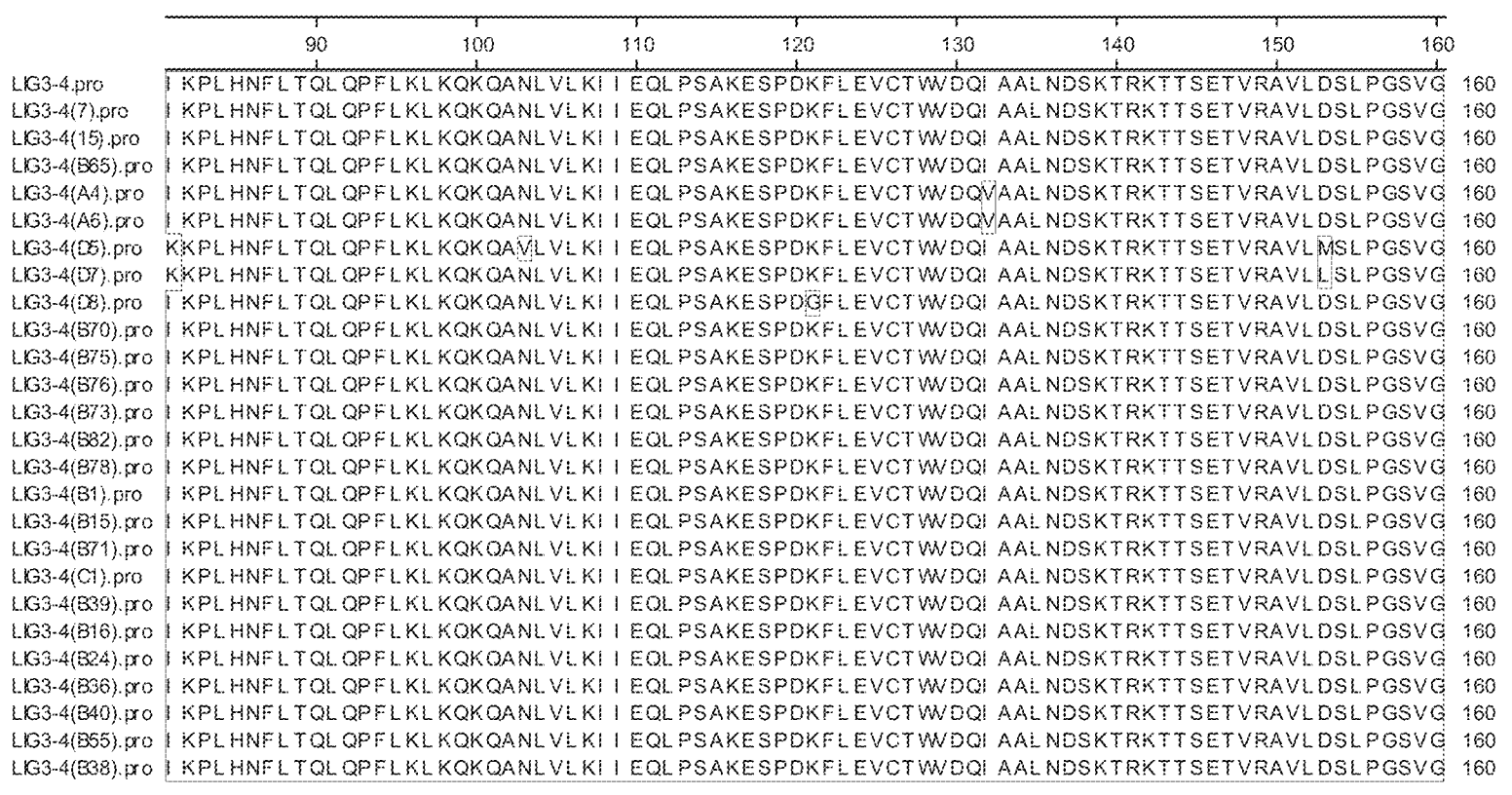
Figure 5C:
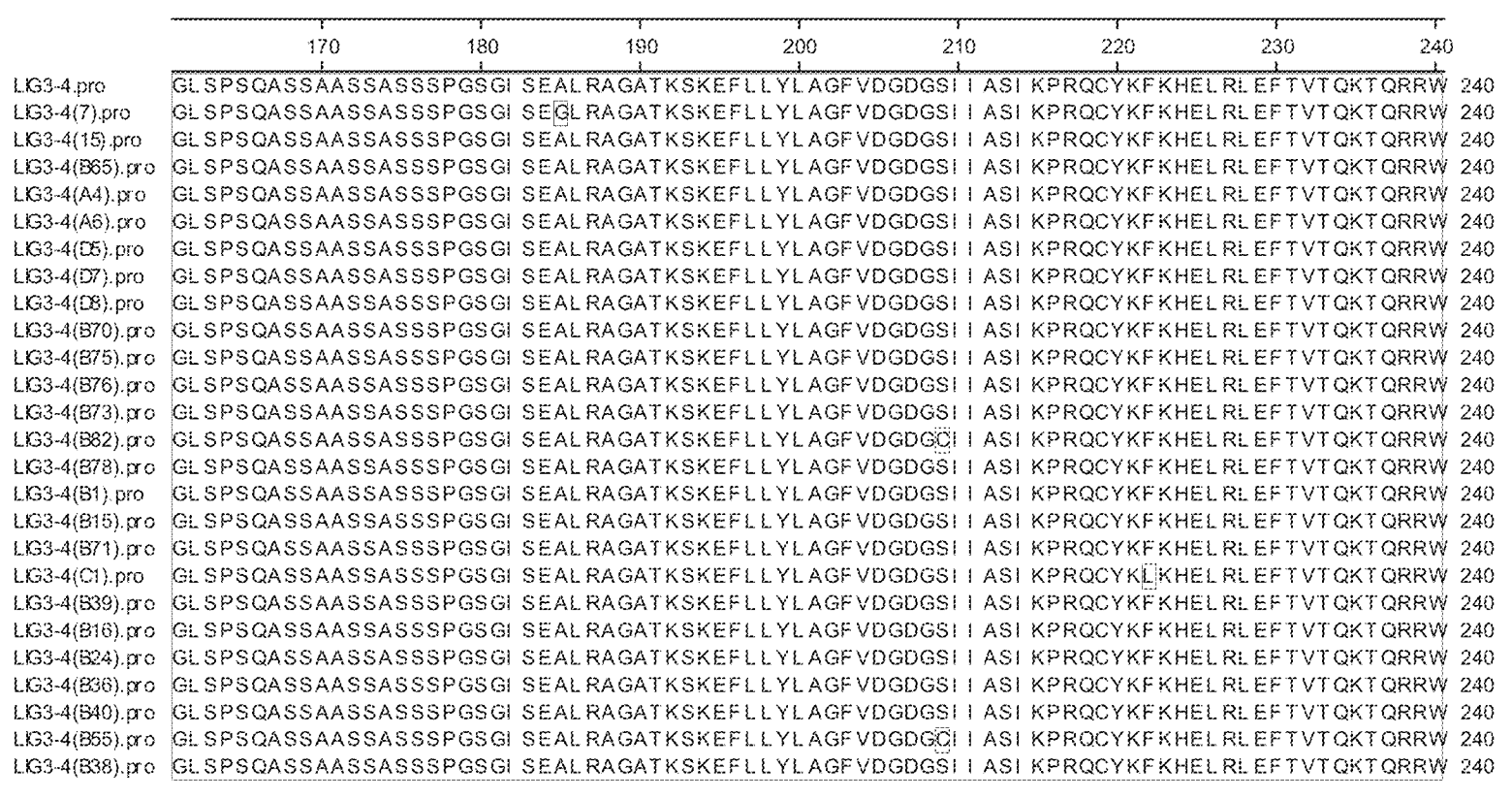
Figure 5D:
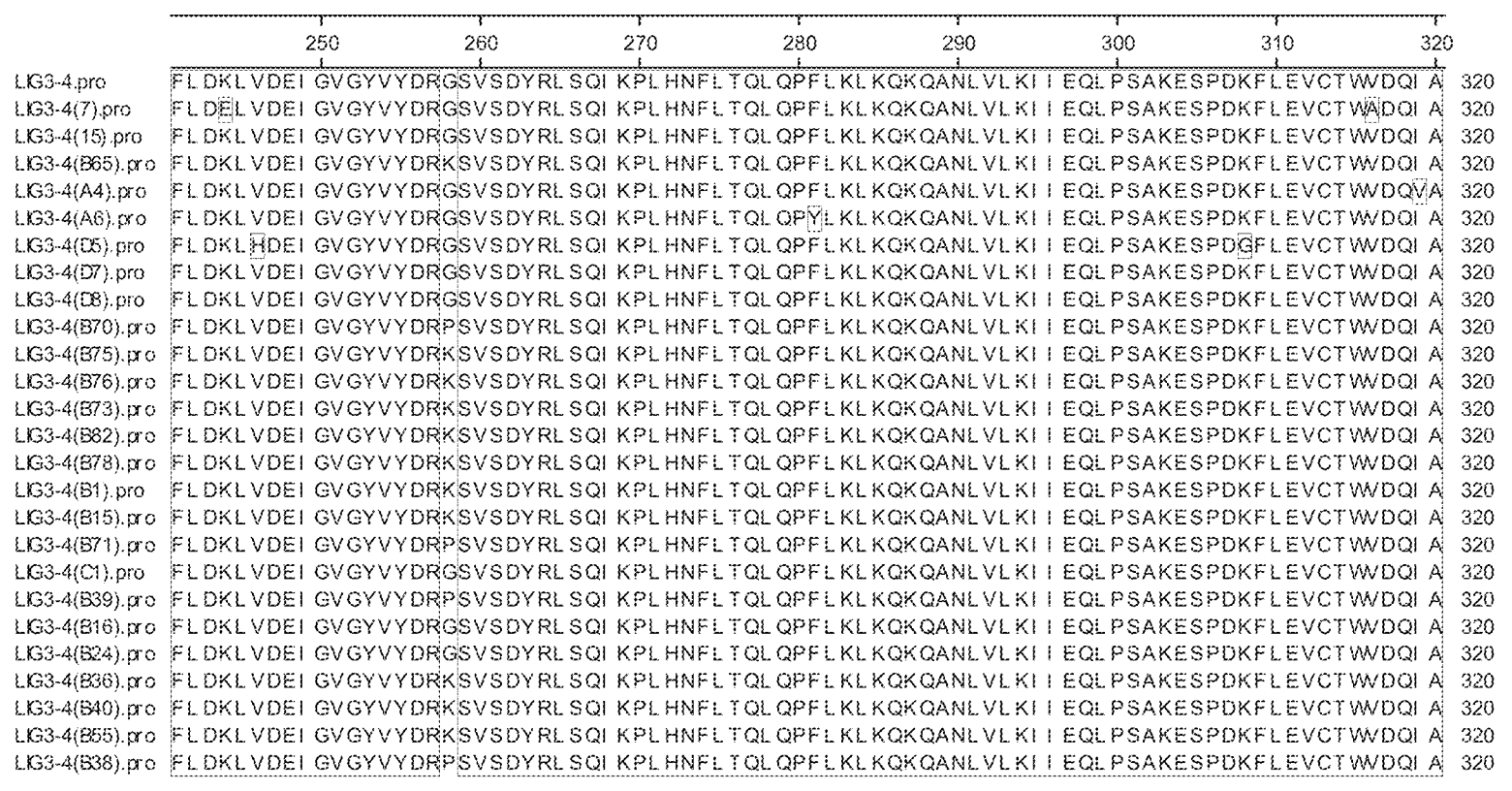

FIG. 5A-FIG. 5E show an amino acid alignment of the parental LIG3-4 (LIG3-4.pro, SEQ ID NO: 1) and LIG3-4 meganuclease variants (Table 1A, SEQ ID NOs: 14-38). The name of the meganuclease listed in FIG. 5A-FIG. 5E corresponds to the name in Table 1A but include a ".pro" to indicate that this is a protein alignment.

Figure 6A:
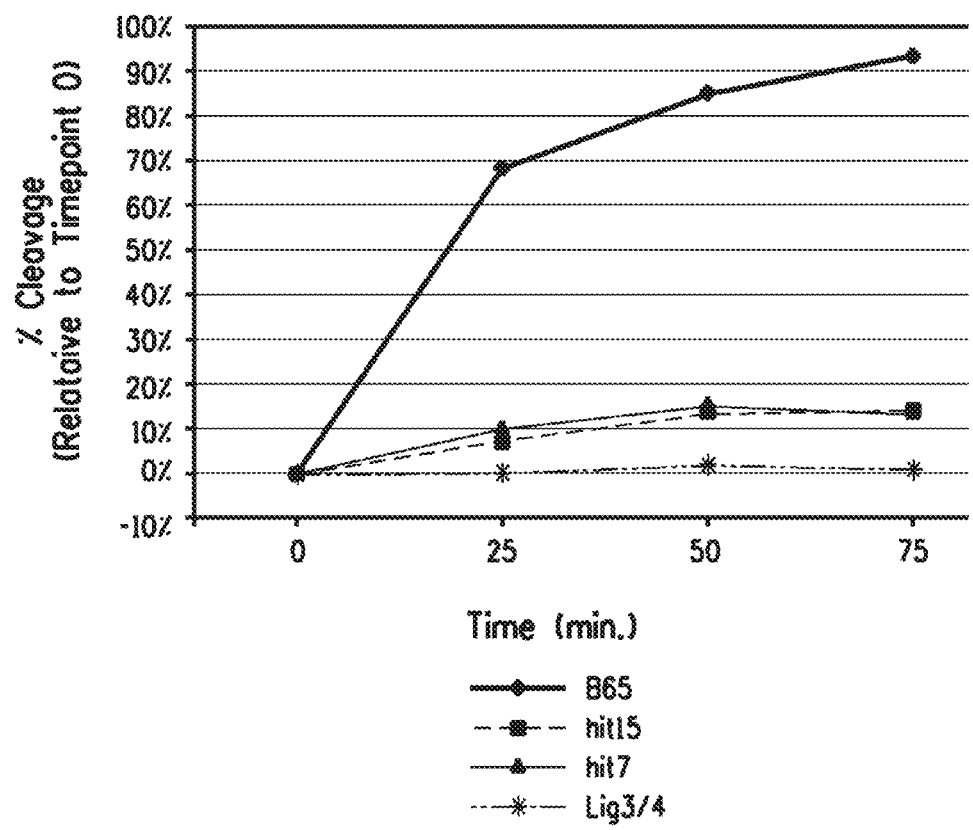
Figure 6B:
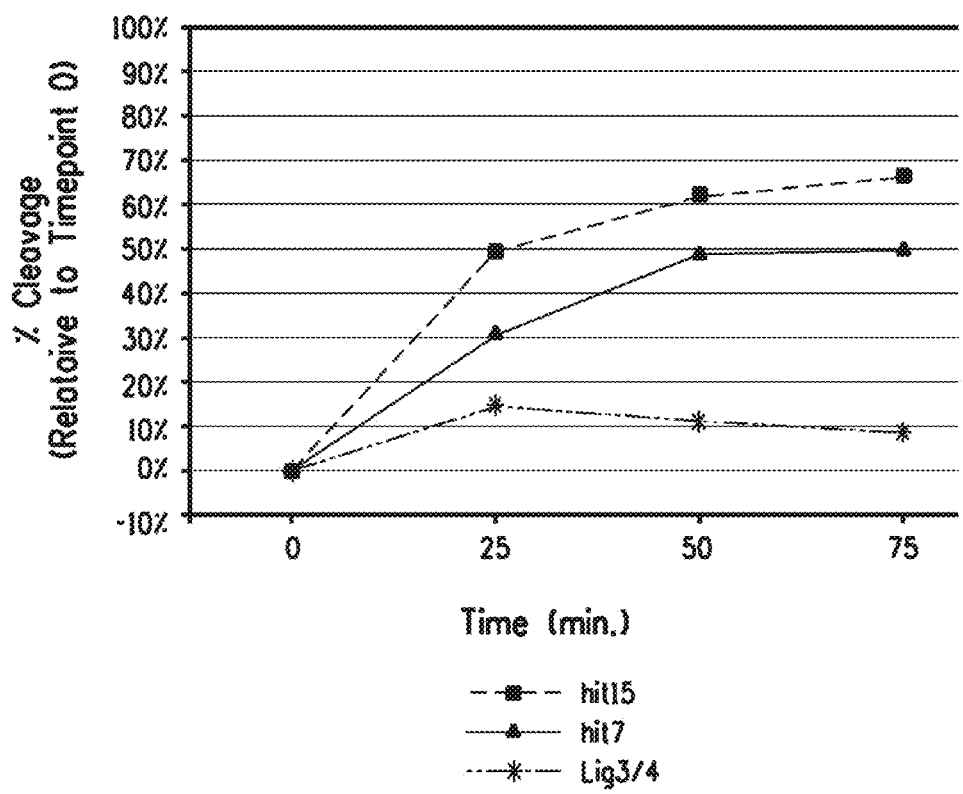
Figure 6C:
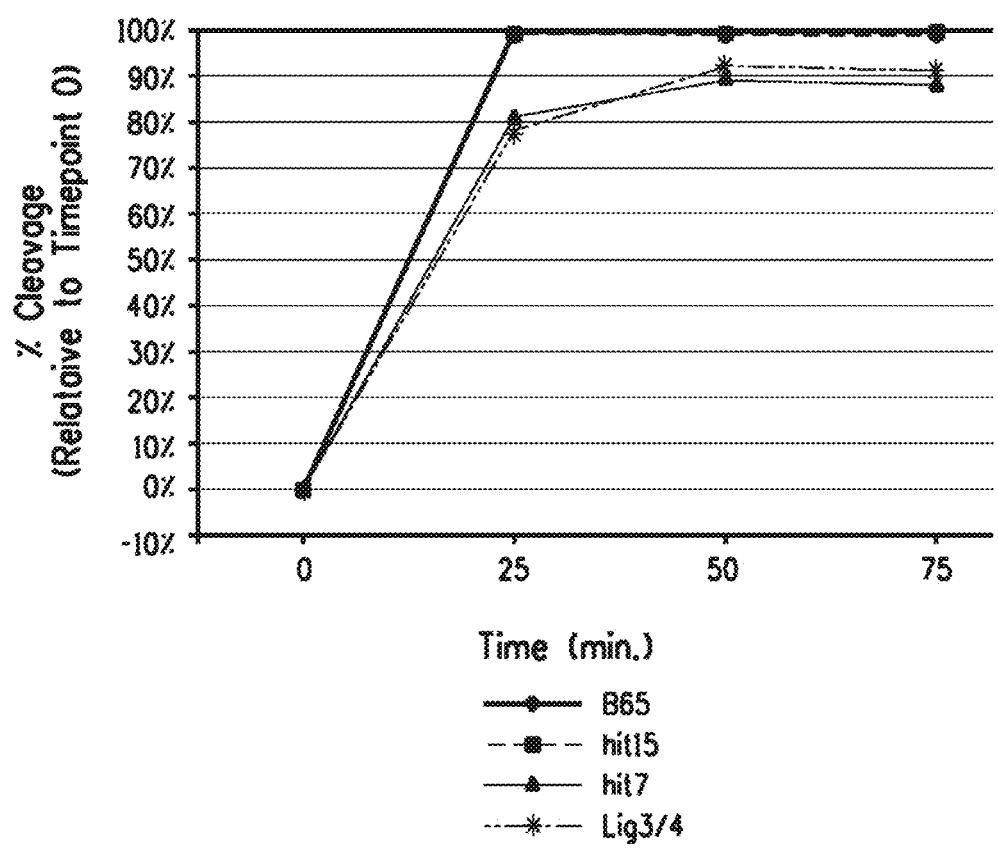

FIG. 6A-FIG. 6C show the percent cleavage by the parental LIG3-4 and LIG3-4 variant meganucleases (B65=LIG3-4(B65); hit15=LIG3-4(15); hit7=LIG3-4(7)) of plasmid DNA substrate at 0, 25, 50 and 75 minutes averaged across three replicates of real-time PCR. FIG. 6A shows the % cleavage observed at 23° C. FIG. 6B shows the % cleavage observed at 28° C. FIG. 6C shows the % cleavage observed at 37° C.

Figure 7A:
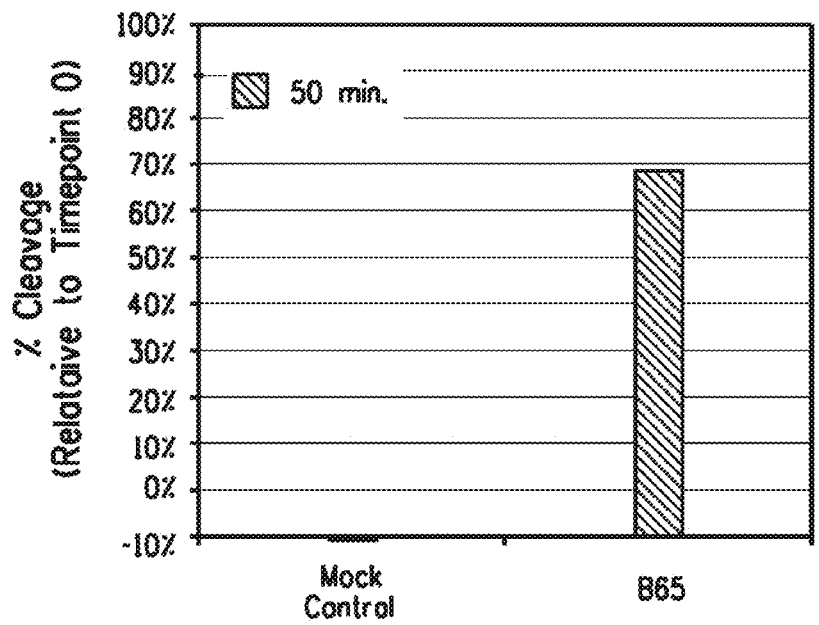
Figure 7B:
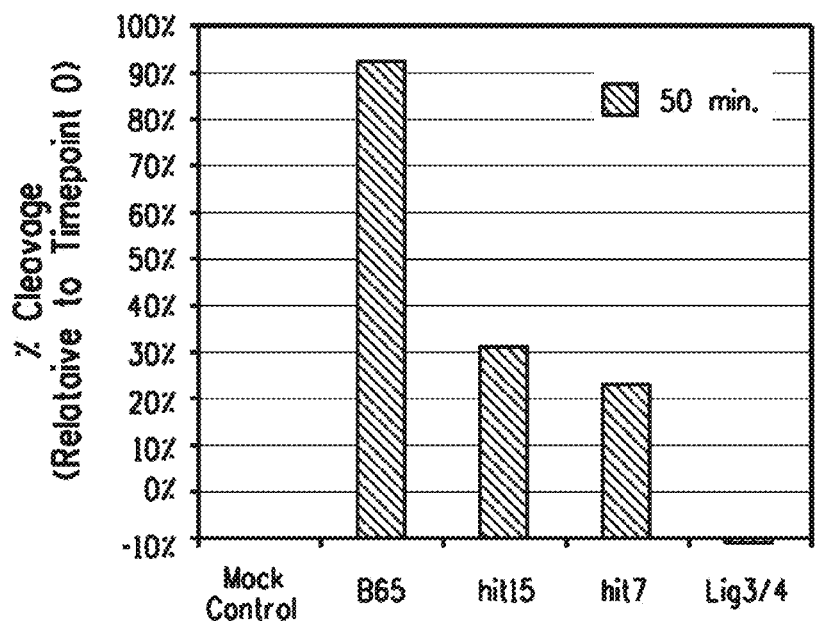
Figure 7C:
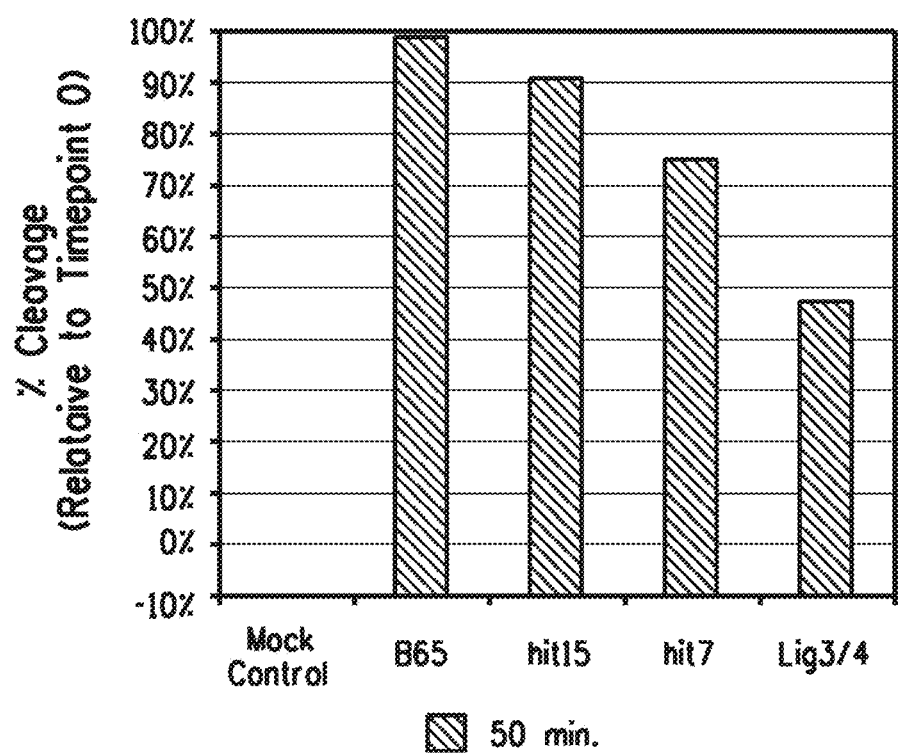

FIG. 7A-FIG. 7C show the percent cleavage by the parental LIG3-4 and LIG3-4 variant meganucleases (B65=LIG3-4(B65); hit15=LIG3-4(15); hit7=LIG3-4(7)) of genomic DNA substrate at 50 minutes averaged across three replicates of real-time PCR. FIG. 7A shows the % cleavage observed at 23° C. FIG. 7B shows the % cleavage observed at 28° C. FIG. 7C shows the % cleavage observed at 37° C.

Figure 8B:
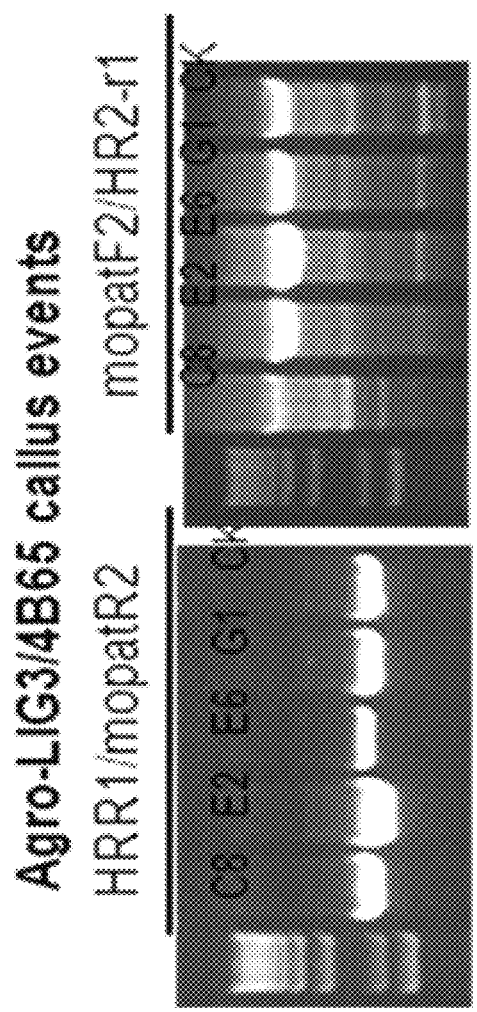

FIG. 8A shows a schematic outline of long fragment PCR reactions used to confirm UBI:moPAT:PinII cassette integration at the endogenous LIG3-4 recognition site. FIG. 8B: shows the results of long fragment PCR on callus from four events where integration occurred at the recognition site. The left panel of FIG. 8B shows the long junction fragment PCR on the HR1 side using genomic primer (HRR1) and moPAT primer (mopatR2); The right panel of FIG. 8B shows the long junction fragment PCR on HR2 side (mopatF2/HR2R2). Primer set mopatF2/HR2R2 amplified a 4 kb fragment, spanning from moPAT gene through the UBI intron, UBI promoter, and the HR2 sequence to the adjacent genomic region. Primer set HRR1/mopatR2 amplified a 2.2 kb fragment, spanning from the moPAT gene through the HR1 to the adjacent genomic region. The sizes of the two long PCR products indicate a perfect integration of the donor gene cassette at LIG3-4 recognition site. Insertion was obtained in T0 and T1 plants from one of the callus event.

Figure 9I:
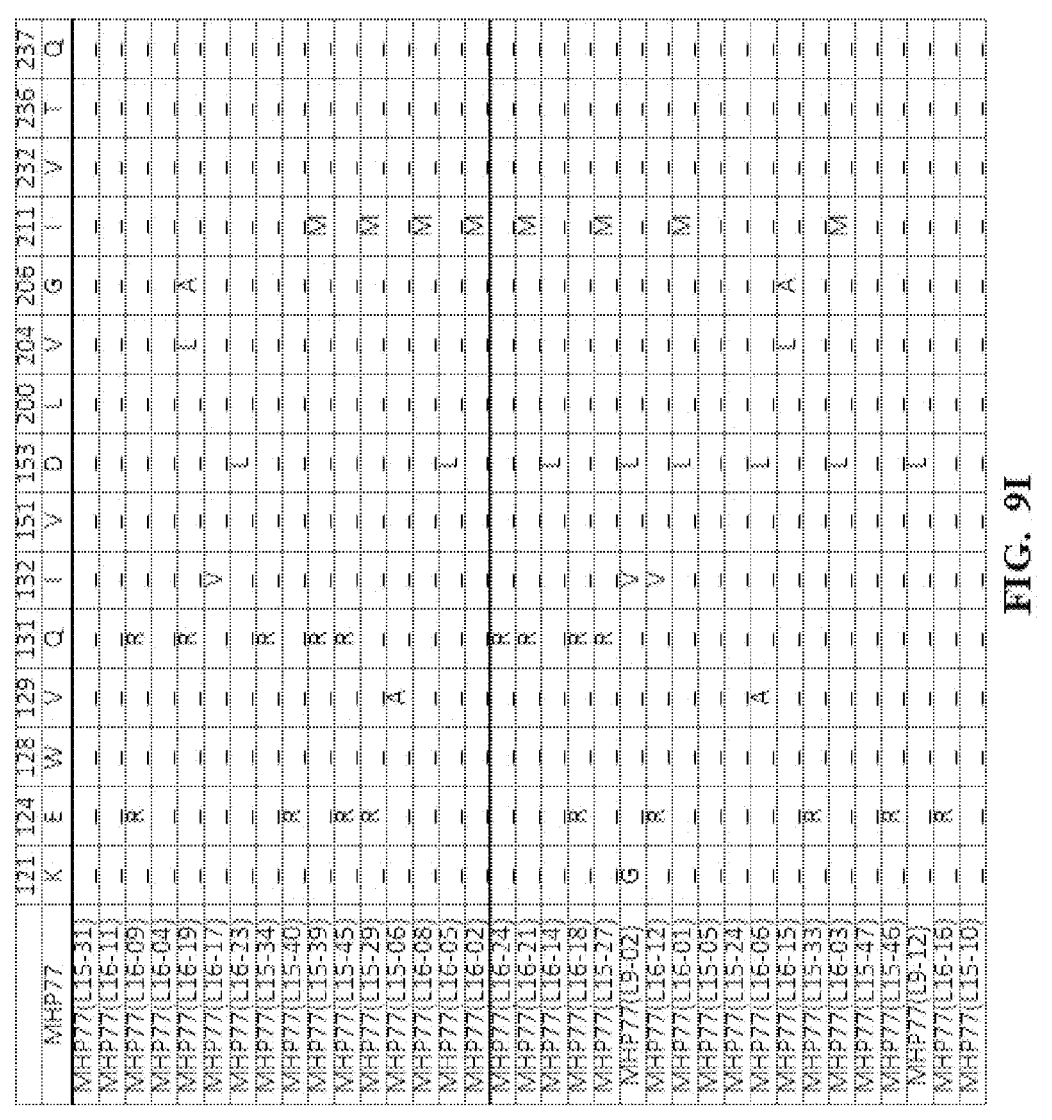
Figure 9J:
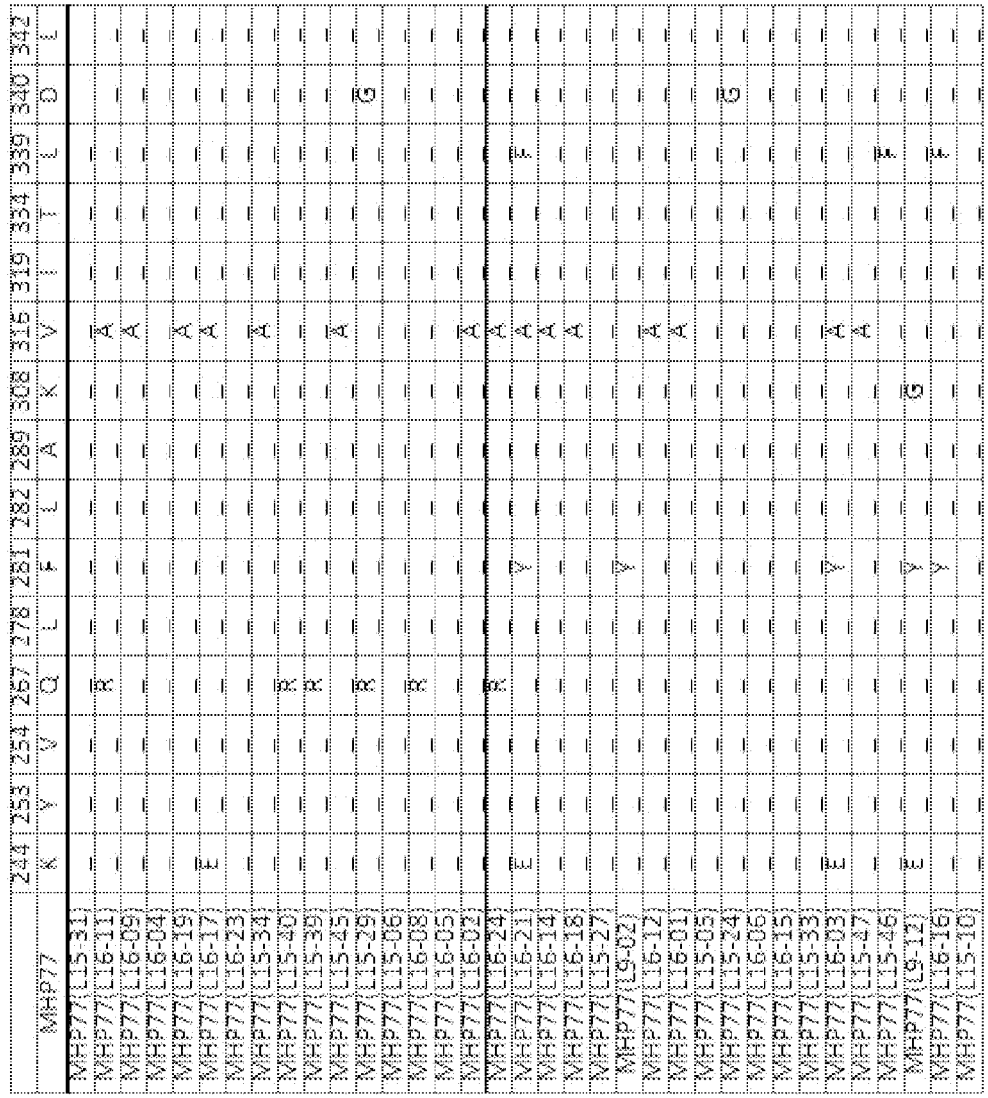

FIG. 9A-FIG. 9N show an amino acid alignment of the parental MHP77 (SEQ ID NO: 86) and MHP77 meganucleases variants (Table 1A, SEQ ID NOs:87-167). The name of the meganuclease listed in FIG. 9A-FIG. 9N corresponds to the name in Table 1A. Amino acid modifications of the variant meganucleases, when compared to the parental meganuclease MHP77, are shown. A (–) indicates that the amino acid residue of the variant and parental meganuclease were identical.

FIG. 10A-FIG. 10D show an amino acid alignment of the parental MHP14 (SEQ ID NO:282) and MHP14 meganuclease variants (Table 1B, SEQ ID NOs:284-298). The name of the meganuclease listed in FIG. 10A-FIG. 10D corresponds to the name in Table 1B. Amino acid modifications of the variant meganucleases, when compared to the parental meganuclease MHP14, are shown. A (–) indicates that the amino acid residue of the variant and parental meganuclease were identical.

FIG. 11 provides an amino acid alignment of the parental MHP107 (SEQ ID NO:329) and MHP107 meganucleases variants (Table 1C, SEQ ID NOs:330-341). The name of the meganuclease listed in FIG. 11 corresponds to the name in Table 1C. Amino acid modifications of the variant meganucleases, when compared to the parental meganuclease, are shown. A (–) indicates that the amino acid residue of the variant and parental meganuclease were identical.

Figure 12:
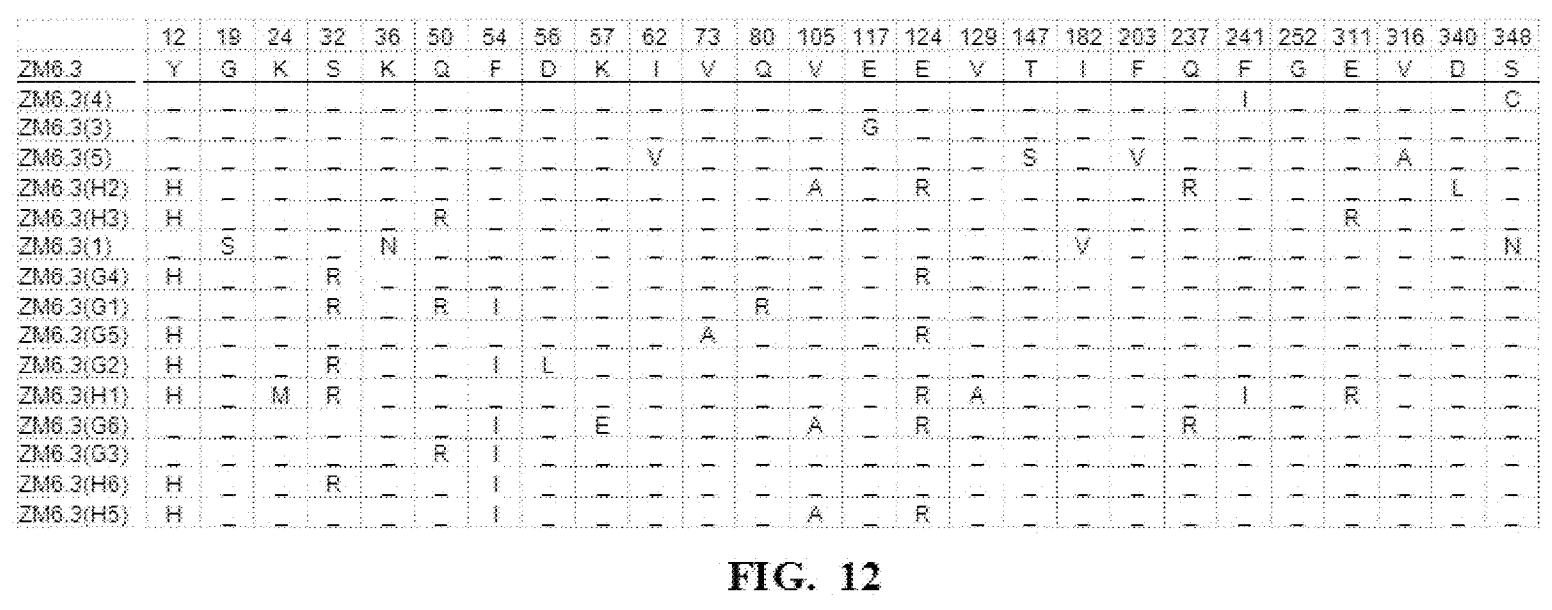

FIG. 12 provides an amino acid alignment of the parental ZM6.3 (SEQ ID NO:356) and ZM6.3 meganucleases variants (Table 1D, SEQ ID NOs:357-371). The name of the meganuclease listed in FIG. 12 corresponds to the name in Table 1D. Amino acid modifications of the variant meganucleases, when compared to the parental meganuclease, are shown. A (–) indicates that the amino acid residue of the variant and parental meganuclease were identical.

FIG. 13 provides an amino acid alignment of the parental ZM6.22v2 (SEQ ID NO:389) and ZM6.22v2 meganucleases variants (Table 1E, SEQ ID NOs:390-403). The name of the meganuclease listed in FIG. 12 corresponds to the name in Table 1E. Amino acid modifications of the variant meganucleases, when compared to the parental meganuclease, are shown. A (–) indicates that the amino acid residue of the variant and parental meganuclease were identical.

Figure 14F:
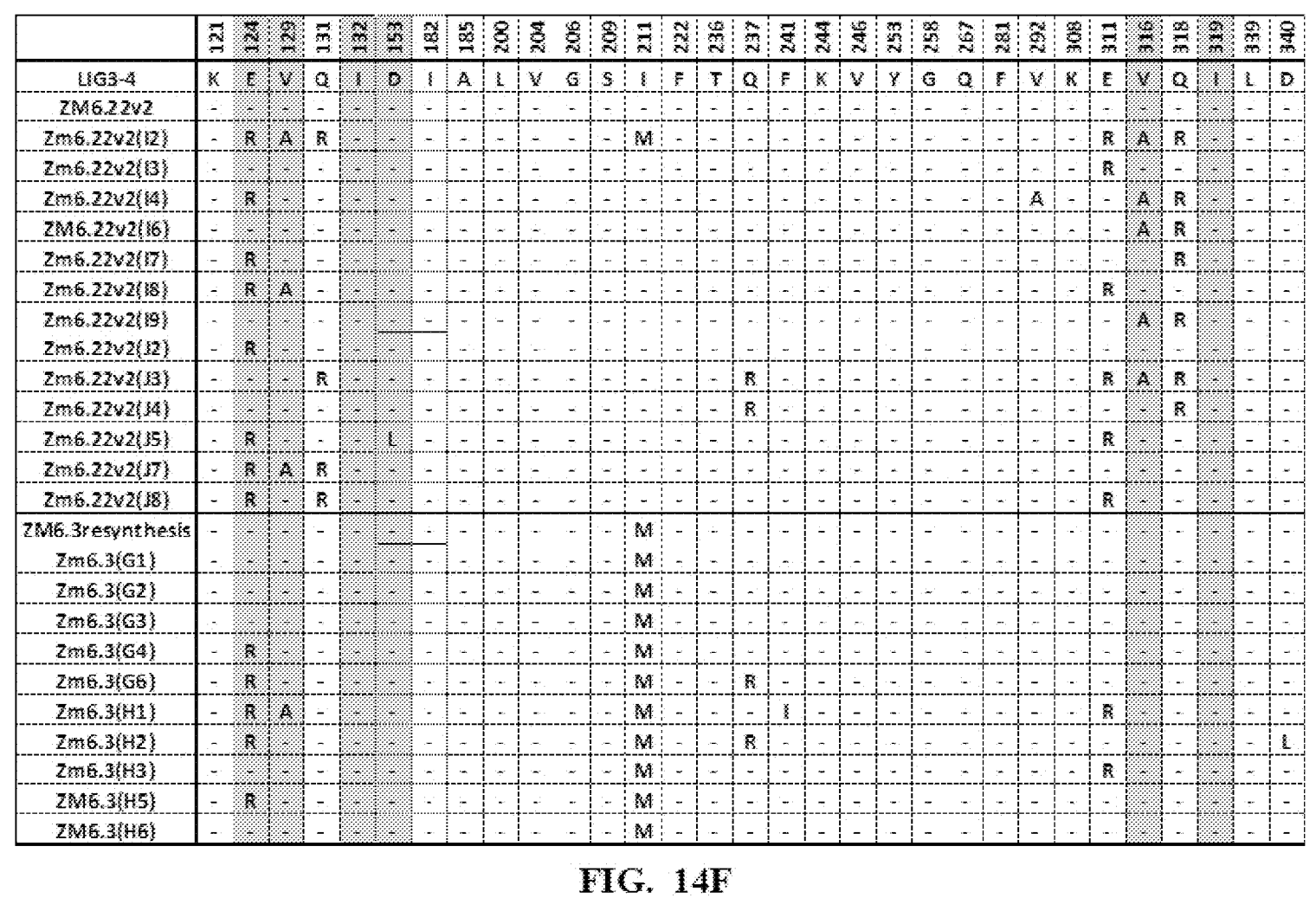

FIG. 14A-FIG.14F show an amino acid alignment of the LIG3-4 meganuclease (SEQ ID NO:1) and multiple meganucleases (The name of the meganuclease listed in FIG. 14A-FIG.14F corresponds to the name in Table 1A-1E and corresponding SEQ ID NOs are shown in Table 1A-1E). Amino acid modifications different from SEQ ID NO:1 are shown. A (–) indicates that the amino acid residue of the meganuclease is identical to the LIG3-4 meganuclease (SEQ ID NO:1). Highlighted in gray are mutations which were correlated with increased meganuclease activity on the desired target site.

FIG. 15A-FIG.15D show an amino acid alignment of some meganucleases comprising a linker polypeptide that links the two re-engineered I-CreI monomers into a single amino chain. FIG. 15 E shows the percent identify of some variant (MHP14(10), MHP77 (L9-01) and parental (LIG3-4, MHP14, MHP77) meganucleases.). Highlighted in gray are the novel linker sequences present in variants MHP14(10) and MHP77(L9-01).

Figure 16:
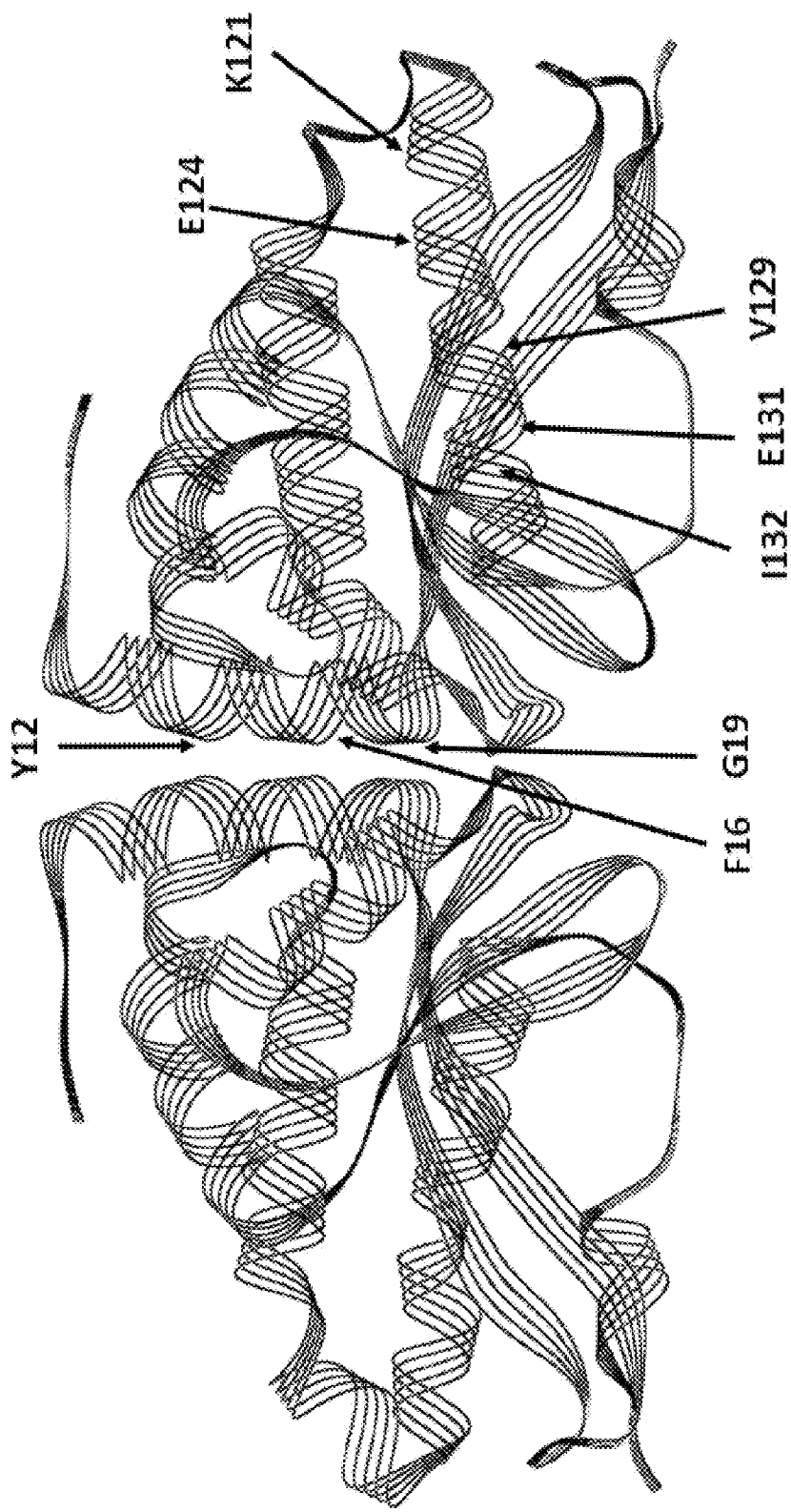

FIG. 16 shows the structural motives of the meganuclease. Alpha helix-1encompasses amino acids 8 through 19 on subunit number 1 and amino acids 195 through 206 on subunit number 2 in SEQ ID NO: 1. Alpha helix-5 encompasses amino acids 120-135 on subunit number 1 and amino acids 307 through 322 on subunit number 2 in SEQ ID NO: 1.

SEQUENCES

SEQ ID NO: 1 is the amino acid sequence of the single chain LIG3-4 meganuclease fusion polypeptide.
SEQ ID NO: 2 is the nucleotide sequence of the LIG3-4 recognition sequence.
SEQ ID NO: 3 is the amino acid sequence of the I-CreI meganuclease monomer.
SEQ ID NO: 4 is the amino acid sequence of gi_18654305
SEQ ID NO: 5 is the amino acid sequence of gi_108773071
SEQ ID NO: 6 is the amino acid sequence of gi_108773352
SEQ ID NO: 7 is the amino acid sequence of gi_108796958
SEQ ID NO: 8 is the amino acid sequence of gi_12667512
SEQ ID NO: 9 is the amino acid sequence of gi_18654311
SEQ ID NO: 10 is the amino acid sequence of gi_150406493
SEQ ID NO: 11 is the amino acid sequence of gi_110225678
SEQ ID NO: 12 is the amino acid sequence of gi_11467050
SEQ ID NO: 13 is the amino acid sequence of gi_18654162
SEQ ID NO: 14 is the amino acid sequence of the LIG3-4 meganuclease.

TABLE 1A

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| LIG3-4 | 1 | 40 |
| LIG3-4(B65) | 27 | 54 |
| LIG3-4(B70) | 28 | 55 |
| LIG3-4(B75) | 31 | 58 |
| LIG3-4(B76) | 32 | 59 |
| LIG3-4(B73) | 30 | 57 |
| LIG3-4(B82) | 34 | 61 |
| LIG3-4(B78) | 33 | 60 |
| LIG3-4(B1) | 18 | 45 |
| LIG3-4(15) | 15 | 42 |
| LIG3-4(D8) | 38 | 65 |
| LIG3-4(B15) | 19 | 46 |
| LIG3-4(C1) | 35 | 62 |
| LIG3-4(B71) | 29 | 56 |
| LIG3-4(B39) | 24 | 51 |
| LIG3-4(B16) | 20 | 47 |
| LIG3-4(D7) | 37 | 64 |
| LIG3-4(B38) | 23 | 50 |
| LIG3-4(B40) | 25 | 52 |
| LIG3-4(B36) | 22 | 49 |
| LIG3-4(B24) | 21 | 48 |
| LIG3-4(B55) | 26 | 53 |
| LIG3-4(A4) | 16 | 43 |

TABLE 1A-continued

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| LIG3-4(D5) | 36 | 63 |
| LIG3-4(7) | 14 | 41 |
| LIG3-4(A6) | 17 | 44 |
| MHP77 | 86 | 168 |
| MHP77(L72-01a) | 87 | 169 |
| MHP77(L72-08a) | 88 | 170 |
| MHP77(L72-09a) | 89 | 171 |
| MHP77(L73-02a) | 90 | 172 |
| MHP77(L73-05a) | 91 | 173 |
| MHP77(L9-01) | 92 | 174 |
| MHP77(L9-02) | 93 | 175 |
| MHP77(L9-03) | 94 | 176 |
| MHP77(L9-04) | 95 | 177 |
| MHP77(L9-06) | 96 | 178 |
| MHP77(L9-09) | 97 | 179 |
| MHP77(L9-10) | 98 | 180 |
| MHP77(L9-11) | 99 | 181 |
| MHP77(L9-12) | 100 | 182 |
| MHP77(L112-03a) | 101 | 183 |
| MHP77(L113-01) | 102 | 184 |
| MHP77(L13-01a) | 103 | 185 |
| MHP77(L13-02) | 104 | 186 |
| MHP77(L13-04) | 105 | 187 |
| MHP77(L13-06) | 106 | 188 |
| MHP77(L13-08a) | 107 | 189 |
| MHP77(L13-10B1) | 108 | 190 |
| MHP77(L13-11) | 109 | 191 |
| MHP77(L13-12) | 110 | 192 |
| MHP77(L15-02) | 111 | 193 |
| MHP77(L15-03) | 112 | 194 |
| MHP77(L15-05) | 113 | 195 |
| MHP77(L15-06) | 114 | 196 |
| MHP77(L15-08) | 115 | 197 |
| MHP77(L15-10) | 116 | 198 |
| MHP77(L15-11) | 117 | 199 |
| MHP77(L15-12) | 118 | 200 |
| MHP77(L15-13) | 119 | 201 |
| MHP77(L15-15) | 120 | 202 |
| MHP77(L15-16) | 121 | 203 |
| MHP77(L15-18) | 122 | 204 |
| MHP77(L15-20) | 123 | 205 |
| MHP77(L15-21) | 124 | 206 |
| MHP77(L15-23) | 125 | 207 |
| MHP77(L15-24) | 126 | 208 |
| MHP77(L15-28) | 127 | 209 |
| MHP77(L15-29) | 128 | 210 |
| MHP77(L15-33) | 129 | 211 |
| MHP77(L15-34) | 130 | 212 |
| MHP77(L15-35) | 131 | 213 |
| MHP77(L15-36) | 132 | 214 |
| MHP77(L15-39) | 133 | 215 |
| MHP77(L15-40) | 134 | 216 |
| MHP77(L15-41) | 135 | 217 |
| MHP77(L15-42) | 136 | 218 |
| MHP77(L15-43) | 137 | 219 |
| MHP77(L15-45) | 138 | 220 |
| MHP77(L15-46) | 139 | 221 |
| MHP77(L15-27) | 140 | 222 |
| MHP77(L15-30) | 141 | 223 |
| MHP77(L15-31) | 142 | 224 |
| MHP77(L15-47) | 143 | 225 |
| MHP77(L16-01) | 144 | 226 |
| MHP77(L16-02) | 145 | 227 |
| MHP77(L16-03) | 146 | 228 |
| MHP77(L16-04) | 147 | 229 |
| MHP77(L16-05) | 148 | 230 |
| MHP77(L16-06) | 149 | 231 |
| MHP77(L16-07) | 150 | 232 |
| MHP77(L16-08) | 151 | 233 |
| MHP77(L16-09) | 152 | 234 |
| MHP77(L16-11) | 153 | 235 |
| MHP77(L16-12) | 154 | 236 |

TABLE 1A-continued

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| MHP77(L16-14) | 155 | 237 |
| MHP77(L16-15) | 156 | 238 |
| MHP77(L16-16) | 157 | 239 |
| MHP77(L16-17) | 158 | 240 |
| MHP77(L16-18) | 159 | 241 |
| MHP77(L16-19) | 160 | 242 |
| MHP77(L16-21) | 161 | 243 |
| MHP77(L16-23) | 162 | 244 |
| MHP77(L16-24) | 163 | 245 |
| MHP77(L17-12) | 164 | 246 |
| MHP77(L18-01) | 165 | 247 |
| MHP77(L18-12) | 166 | 248 |
| MHP77(L17-01) | 167 | 249 |

SEQ ID NO: 39 is the plant optimized nucleotide sequence of LIG3-4 comprising a nuclear localization signal and an intron.

SEQ ID NO: 66 is the nucleotide sequence of MN031 primer.

SEQ ID NO: 67 is the nucleotide sequence of MN022 primer.

SEQ ID NO: 68 is the nucleotide sequence of plasmid pVER8134.

SEQ ID NO: 69 is the nucleotide sequence of a nuclear localization signal.

SEQ ID NO: 70 is the amino acid sequence of a nuclear localization signal.

SEQ ID NO: 71 is the amino acid sequence of 6× histidine tag.

SEQ ID NO: 72 is the nucleotide sequence of a nuclear localization signal in maize.

SEQ ID NO: 73 is the plant-optimized nucleotide sequence of the LIG3-4(7) meganuclease with a nuclear localization signal and an intron.

SEQ ID NO: 74 is the plant-optimized nucleotide sequence of the LIG3-4(15) meganuclease with a nuclear localization signal and an intron.

SEQ ID NO: 75 is the plant-optimized nucleotide sequence of the LIG3-4(B65) meganuclease with a nuclear localization signal and an intron.

SEQ ID NO: 76 is the nucleotide sequence of plasmid PHP46961.

SEQ ID NO: 77 is the nucleotide sequence of LIG3-4 (HR1).

SEQ ID NO: 78 is the nucleotide sequence of LIG3-4 (HR2).

SEQ ID NO: 79 is the nucleotide sequence of LIG3-4 target site qPCR probe.

SEQ ID NO: 80 is the nucleotide sequence of Lig3-4_forward primer.

SEQ ID NO: 81 is the nucleotide sequence of Lig3-4_reverse primer.

SEQ ID NO: 82 is the nucleotide sequence of yeast ade2.

SEQ ID NO: 83 is the nucleotide coding sequence of ade2.

SEQ ID NO: 84 is the nucleotide sequence of plasmid pHD1327.

SEQ ID NO: 85 is the nucleotide sequence the MHP77 recognition site.

SEQ ID NO: 86 is the amino acid sequence of the MHP77 meganuclease.

SEQ ID NO: 250 is the amino acid sequence of the MHP77.3 meganuclease.

SEQ ID NO: 251 is the amino acid sequence of the MHP77.3 (L9-02) meganuclease.

SEQ ID NO: 252 is the amino acid sequence of the MHP77.3 (L9-11) meganuclease.

SEQ ID NO: 253 is the amino acid sequence of the MHP77.3 (L9-12) meganuclease.

SEQ ID NO: 254 is the plant-optimized nucleotide sequence of MHP77 comprising a nuclear localization signal and lacking an intron.

SEQ ID NO: 255 is the plant-optimized nucleotide sequence of MHP77.3 meganuclease MHP77 comprising a nuclear localization signal and lacking an intron.

SEQ ID NO: 256 is the plant-optimized nucleotide sequence of MHP77(L9-02) meganuclease comprising a nuclear localization signal and an intron.

SEQ ID NO: 257 is the plant-optimized nucleotide sequence of the MHP77 (L9-11) meganuclease comprising a nuclear localization signal and an intron.

SEQ ID NO: 258 is the plant-optimized nucleotide sequence of the MHP77 (L9-12) meganuclease comprising a nuclear localization signal and an intron SEQ ID NO: 259 is the plant-optimized nucleotide sequence of MHP77.3 (L9-02) meganuclease comprising a nuclear localization signal and an intron.

SEQ ID NO:260 is the plant-optimized nucleotide sequence of the MHP77.3 (L9-11) meganuclease comprising a nuclear localization signal and an intron.

SEQ ID NO:261 is the plant-optimized nucleotide sequence of the MHP77.3 (L9-12) meganuclease comprising a nuclear localization signal and an intron SEQ ID NO:262 is the amino acid sequence of the MHP77.3(15) meganuclease.

SEQ ID NO:263 is the plant-optimized nucleotide sequence of MHP77.3(15) meganuclease comprising a nuclear localization signal and an intron.

SEQ ID NO:264 is the nucleotide sequence of the MHP77HR1.

SEQ ID NO:265 is the nucleotide sequence of the MHP77HR2.

SEQ ID NO:266 is the nucleotide sequence of the MHP77 target site qPCR probe.

SEQ ID NO:267 is the nucleotide sequence of the MHP77_forward primer.

SEQ ID NO:268 is the nucleotide sequence of the MHP77_reverse primer.

SEQ ID NO:269 is the nucleotide sequence of the MS26 recognition site.

SEQ ID NO:270 is the amino acid sequence of the MS26+ meganuclease.

SEQ ID NO:271 is the amino acid sequence of the MS26++ meganuclease.

SEQ ID NO:272 is the amino acid sequence of the MS26+(7) meganuclease.

SEQ ID NO:273 is the amino acid sequence of the MS26+(15) meganuclease.

SEQ ID NO:274 is the amino acid sequence of the MS26+(B65) meganuclease.

SEQ ID NO:275 is the amino acid sequence of the MS26++(15) meganuclease.

SEQ ID NO:276 is the plant-optimized nucleotide sequence of MS26+ and no intron

SEQ ID NO:419 is the plant-optimized nucleotide sequence of MS26+(7) and no intron SEQ ID NO:277 is the plant-optimized nucleotide sequence of MS26+(15) and no intron SEQ ID NO:278 is the plant-optimized nucleotide sequence of MS26+(B65) and no intron;

SEQ ID NO:279 is the plant-optimized nucleotide sequence of MS26++ and no intron SEQ ID NO:280 is the plant-optimized nucleotide sequence of MS26++(15) and no intron SEQ ID NO:281 is the nucleotide sequence of the MHP14 recognition site.

TABLE 1B

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| MHP14 | 282 | 299 |
| MHP14+ | 283 | |
| MHP14(01) | 284 | 300 |
| MHP14(02) | 285 | 301 |
| MHP14(03) | 286 | 302 |
| MHP14(04) | 287 | 303 |
| MHP14(06) | 288 | 304 |
| MHP14(07) | 289 | 305 |
| MHP14(08) | 290 | 306 |
| MHP14(09) | 291 | 307 |
| MHP14(10) | 292 | 308 |
| MHP14(12) | 293 | 309 |
| MHP14(13) | 294 | 310 |
| MHP14(14) | 295 | 311 |
| MHP14(L14-03) | 296 | 312 |
| MHP14(L14-04) | 297 | 313 |
| MHP14(L14-07) | 298 | 314 |

SEQ ID NO:315 is the amino acid sequence of the MHP14+(04) meganuclease.

SEQ ID NO: 316 is the amino acid sequence of the MHP14+(06) meganuclease.

SEQ ID NO: 317 is the amino acid sequence of the MHP14+(08) meganuclease.

SEQ ID NO: 318 is the amino acid sequence of the MHP14+(12) meganuclease.

SEQ ID NO: 319 is the amino acid sequence of the MHP14+(14) meganuclease.

SEQ ID NO:320 is the amino acid sequence of the MHP14+(15) meganuclease.

SEQ ID NO:321 is the plant-optimized nucleotide sequence of MHP14 and an intron.

SEQ ID NO:322 is the plant-optimized nucleotide sequence of MHP14+(04) and an intron.

SEQ ID NO:323 is the plant-optimized nucleotide sequence of MHP14+(06) and an intron.

SEQ ID NO:324 is the plant-optimized nucleotide sequence of MHP14+(08) and an intron.

SEQ ID NO:325 is the plant-optimized nucleotide sequence of MHP14+(12) and an intron.

SEQ ID NO:326 is the plant-optimized nucleotide sequence of MHP14+(14) and an intron.

SEQ ID NO:327 is the plant-optimized nucleotide sequence of MHP14+(15) and an intron.

SEQ ID NO:328 is the nucleotide sequence of the MHP107 recognition site.

TABLE 1C

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| MHP107 | 329 | 342 |
| MHP107(C1) | 330 | 343 |
| MHP107(C2) | 331 | 344 |
| MHP107(C3) | 332 | 345 |
| MHP107(C4) | 333 | 346 |
| MHP107(C5) | 334 | 347 |
| MHP107(C6) | 335 | 348 |
| MHP107(D2) | 336 | 349 |
| MHP107(D3) | 337 | 350 |
| MHP107(D4) | 338 | 351 |
| MHP107(D5) | 339 | 352 |
| MHP107(D1) | 340 | 353 |
| MHP107(D6) | 341 | 354 |

SEQ ID NO:355 is the nucleotide sequence of the ZM6.3 recognition site.

TABLE 1D

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| ZM6.3 | 356 | 372 |
| ZM6.3(G1) | 357 | 373 |
| ZM6.3(G2) | 358 | 374 |
| ZM6.3(G3) | 359 | 375 |
| ZM6.3(G4) | 360 | 376 |
| ZM6.3(G5) | 361 | 377 |
| ZM6.3(G6) | 362 | 378 |
| ZM6.3(H1) | 363 | 379 |
| ZM6.3(H2) | 364 | 380 |
| ZM6.3(H3) | 365 | 381 |
| ZM6.3(H5) | 366 | 382 |
| ZM6.3(H6) | 367 | 383 |
| ZM6.3(1) | 368 | 384 |
| ZM6.3(3) | 369 | 385 |
| ZM6.3(4) | 370 | 386 |
| ZM6.3(5) | 371 | 387 |

SEQ ID NO:388 is the nucleotide sequence of the ZM6.22v2 recognition site.

TABLE 1E

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| ZM6.22v2 | 389 | 404 |
| ZM6.22v2(J2) | 390 | 405 |
| ZM6.22v2(J3) | 391 | 406 |
| ZM6.22v2(J4) | 392 | 407 |
| ZM6.22v2(J5) | 393 | 408 |
| ZM6.22v2(I2) | 394 | 409 |
| ZM6.22v2(I3) | 395 | 410 |
| ZM6.22v2(I4) | 396 | 411 |
| ZM6.22v2(I5) | 397 | 412 |
| ZM6.22v2(I6) | 398 | 413 |
| ZM6.22v2(I7) | 399 | 414 |

TABLE 1E-continued

Listing of SEQ ID NO: s (NT = nucleotide sequence; AA = amino acid sequence) for parental and variant meganucleases.

| Name | AA SEQ ID NO: | DNA for expression in yeast SEQ ID NO: |
|---|---|---|
| ZM6.22v2(I8) | 400 | 415 |
| ZM6.22v2(I9) | 401 | 416 |
| ZM6.22v2(J7) | 402 | 417 |
| ZM6.22v2(J8) | 403 | 418 |

SEQ ID NO: 419 is the nucleotide sequence of the MS26+(7) variant meganuclease with no intron SEQ ID NO: 420 is the nucleotide sequence of the linker polypeptide of LIG3-4, MHP14, MHP77.

SEQ ID NO: 421 is the nucleotide sequence of the linker polypeptide of MHP14(10).

SEQ ID NO: 422 is the nucleotide sequence of the linker polypeptide of MHP77(L9-01)

SEQ ID NO: 423 is the nucleotide sequence of the TS21 recognition site in soybean genome.

SEQ ID NO: 424 is the nucleotide sequence of the TS14 recognition site in soybean genome.

SEQ ID NO: 425 is the plant-optimized nucleotide sequence of the TS21 meganuclease with a nuclear localization signal and an intron.

SEQ ID NO: 426 is the plant-optimized nucleotide sequence of the TS21(7) meganuclease with a nuclear localization signal and an intron.

SEQ ID NO: 427 is the plant-optimized nucleotide sequence of the TS21(15) meganuclease with a nuclear localization signal and an intron.

SEQ ID NO: 428 plant-optimized nucleotide sequence of the TS21(B65) meganuclease with a nuclear localization signal and an intron.

SEQ ID NO: 429 is the amino acid sequence of the TS21 meganuclease.

SEQ ID NO: 430 is the amino acid sequence of the TS21(7) meganuclease.

SEQ ID NO: 431 is the amino acid sequence of the TS21(15) meganuclease.

SEQ ID NO: 432 is the amino acid sequence of the TS21(B65) meganuclease

SEQ ID NO: 433 is the plant-optimized nucleotide sequence of TS14 meganuclease with a nuclear localization signal and an intron.

SEQ ID NO: 434 is the plant-optimized nucleotide sequence of TS14(15) meganuclease with a nuclear localization signal and an intron SEQ ID NO: 435 is the amino acid sequence of the TS14 meganuclease.

SEQ ID NO: 436 is the amino acid sequence of the TS14(15) meganuclease.

DETAILED DESCRIPTION OF THE INVENTION

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

As used herein and in the appended claims, the singular forms "a", "an", and "the" include plural reference unless the context clearly dictates otherwise. Thus, for example, reference to "a plant" includes a plurality of such plants; reference to "a cell" includes one or more cells and equivalents thereof known to those skilled in the art, and so forth.

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, specific examples of appropriate materials and methods are described herein. In the context of this disclosure, a number of terms and abbreviations are used. The following definitions are provided.

I. Overview

Compositions and methods comprising polynucleotides and polypeptides having meganuclease activity are provided. Also provided are compositions with increased meganuclease activity and methods of use. Further provided are nucleic acid constructs, yeasts, plants, plant cells, explants, seeds and grain having the meganuclease sequences. The methods and compositions employ endonucleases capable of inducing a double-strand break at a recognition sequence within a DNA fragment or within the genome of a yeast cell, plant, plant cell or seed.

II. Compositions

As used herein, an "isolated" polynucleotide or polypeptide, or biologically active portion thereof, is substantially or essentially free from components that normally accompany or interact with the polynucleotide or polypeptide as found in its naturally occurring environment. Thus, an isolated or purified polynucleotide or polypeptide is substantially free of other cellular material or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A polypeptide that is substantially free of cellular material includes preparations of polypeptides having less than about 30%, 20%, 10%, 5%, or 1% (by dry weight) of contaminating protein. When the polypeptide of the invention or biologically active portion thereof is recombinantly produced, optimally culture medium represents less than about 30%, 20%, 10%, 5%, or 1% (by dry weight) of chemical precursors or non-protein-of-interest chemicals.

As used herein, polynucleotide or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A polypeptide expressed in vitro or in vivo from a recombinant polynucleotide is an example of a recombinant polypeptide. Likewise, a polynucleotide sequence that does not appear in nature, for example, a variant of a naturally occurring gene is recombinant.

A "subsequence" or "fragment" is any portion of an entire sequence.

The terms "target site", "target sequence", "genomic target site" and "genomic target sequence" are used interchangeably herein and refer to a polynucleotide sequence in the genome of a plant cell or yeast cell that comprises a recognition sequence for a double-strand break inducing agent.

As used herein, the term "recognition sequence" refers to a DNA sequence at which a double-strand break is induced in the plant cell genome by an endonuclease. The terms "recognition sequence", "recognition site", "recognition site for an endonuclease", "meganuclease recognition sequence" and "meganuclease recognition site" are used interchangeably herein. The recognition site can be an endogenous site in the plant genome, or alternatively, the recognition site can be heterologous to the plant and thereby not be naturally occurring in the genome, or the recognition site can be found in a heterologous genomic location compared to where it occurs in nature. As used herein, the term "endogenous recognition site" refers to an endonuclease recognition site that is endogenous or native to the genome of a plant and is located at the endogenous or native position of that recognition site in the genome of the plant. The length of the recognition site can vary, and includes, for example, recognition sites that are at least 4, 6, 8, 10, 12, 14, 16, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more nucleotides in length. It is further possible that the recognition site could be palindromic, that is, the sequence on one strand reads the same in the opposite direction on the complementary strand. The nick/cleavage site could be within the recognition sequence or the nick/cleavage site could be outside of the recognition sequence. In another variation, the cleavage could occur at nucleotide positions immediately opposite each other to produce a blunt end cut or, in other cases, the incisions could be staggered to produce single-stranded overhangs, also called "sticky ends", which can be either 5' overhangs, or 3' overhangs.

In one embodiment, the recognition sequence of the endonuclease comprises the LIG3-4 (SEQ ID NO: 2), MHP77 (SEQ ID NO: 85), MS26 (SEQ ID NO: 269), MHP14 (SEQ ID NO: 281), MP107 (SEQ ID NO: 328), ZM6.3 (SEQ ID NO: 355) and/or ZM6.22V2 (SEQ ID NO: 388) recognition sites of maize and/or the TS21 (SEQ ID NO:423) and/or the TS14 (SEQ ID NO:424) recognition sites of soybean.

Active variants and fragments of the recognition can comprise at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the given recognition sequence, wherein the active variants retain biological activity and hence are capable of being recognized and cleaved by an endonuclease.

An "artificial target sequence" is a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

The terms "endogenous target sequence" and "native target sequence" are used interchangeable herein to refer to a target sequence that is endogenous or native to the genome of a plant and is at the endogenous or native position of that target sequence in the genome of the plant.

An "altered target sequence" refers to a target sequence that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

The term "double-strand-break-inducing agent" as used herein refers to any nuclease which produces a double-strand break in the target sequence. Producing the double-strand break in a target sequence or other DNA can be referred to herein as "cutting" or "cleaving" the target sequence or other DNA.

An "endonuclease" refers to an enzyme that cleaves the phosphodiester bond within a polynucleotide chain.

Endonucleases include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Type I and Type III restriction endonucleases recognize specific recognition sites, but typically cleave at a variable position from the recognition site, which can be hundreds of base pairs away from the recognition site. In Type II systems the restriction activity is independent of any methylase activity, and cleavage typically occurs at specific sites within or near to the recognition site. Most Type II enzymes cut palindromic sequences, however Type IIa enzymes recognize non-palindromic recognition sites and cleave outside of the recognition site, Type IIb enzymes cut sequences twice with both sites outside of the recognition site, and Type IIs enzymes recognize an asymmetric recognition site and cleave on one side and at a defined distance of about 1-20 nucleotides from the recognition site. Type IV restriction enzymes target methylated DNA. Restriction enzymes are further described and classified, for example in the REBASE database (webpage at rebase.neb.com; Roberts et al., (2003) Nucleic Acids Res 31:418-20), Roberts et al., (2003) Nucleic Acids Res 31:1805-12, and Belfort et al., (2002) in Mobile DNA II, pp. 761-783, Eds. Craigie et al., (ASM Press, Washington, D.C.).

An "engineered endonuclease" refers to an endonuclease that is engineered (modified or derived) from its native form to specifically recognize and induce a double-strand break in the desired recognition site. Thus, an engineered endonuclease can be derived from a native, naturally-occurring endonuclease or it could be artificially created or synthesized. The modification of the endonuclease can be as little as one nucleotide. In some embodiments, the engineered endonuclease induces a double-strand break in a recognition site, wherein the recognition site was not a sequence that would have been recognized by a native (non-engineered or non-modified) endonuclease. Producing a double-strand break in a recognition site or other DNA can be referred to herein as "cutting" or "cleaving" the recognition site or other DNA.

A "meganuclease" refers to a homing endonuclease, which like restriction endonucleases, bind and cut at a specific recognition site, however the recognition sites for meganucleases are typically longer, about 18 bp or more. In some embodiments of the invention, the meganuclease has been engineered (or modified) to cut a specific endogenous recognition sequence, wherein the endogenous target sequence prior to being cut by the engineered double-strand-break-inducing agent was not a sequence that would have been recognized by a native (non-engineered or non-modified) endonuclease.

A "meganuclease polypeptide" refers to a polypeptide having meganuclease activity and thus capable of producing a double-strand break in the recognition sequence.

Meganucleases have been classified into four families based on conserved sequence motifs, the families are the LAGLIDADG (SEQ ID NO: 437), GIYX$_n$YIG (wherein X is an amino acid and n can range from 10 to 11 amino acids (for example SEQ ID NO: 438 for n =10), HX$_n$NX$_m$H wherein X is any amino acid and n can range from 10 to 14 amino acids and m can range from 7 to 8 amino acids; for example SEQ ID NO: 439 for n =10, m=8), and HXCX$_n$CXXXXHX$_m$C box families (wherein X is any amino acid and n can range from 4 to 5 amino acids, m can range from 16 to 17 amino acids; for example SEQ ID NO: 440 for n =4, m=16). (Belfort M, and Perlman P S J. Biol. Chem. 1995;270:30237-30240). These motifs participate in the coordination of metal ions and hydrolysis of phosphodiester bonds. HEases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing open reading frames, introns, and inteins, respectively. For example, intron-, intein-, and freestanding gene encoded meganuclease from Saccharomyces cerevisiae are denoted I-SceI, PI-SceI, and F-SceII, respectively. Meganuclease domains, structure and function are known, see for example, Guhan and Muniyappa (2003) Crit Rev Biochem Mol Biol 38:199-248; Lucas et al., (2001) Nucleic Acids Res 29:960-9; Jurica and Stoddard, (1999) Cell Mol Life Sci 55:1304-26; Stoddard, (2006) Q Rev Biophys 38:49-95; and Moure et al., (2002) Nat Struct Biol 9:764. In some examples a naturally occurring variant, and/or engineered derivative meganuclease is used. Methods for modifying the kinetics, cofactor interactions, expression, optimal conditions, and/or recognition site specificity, and screening for activity are known, see for example, Epinat et al., (2003) Nucleic Acids Res 31:2952-62; Chevalier et al., (2002) Mol Cell 10:895-905; Gimble et al., (2003) Mol Biol 334:993-1008; Seligman et al., (2002) Nucleic Acids Res 30:3870-9; Sussman et al., (2004) J Mol Biol 342:31-41; Rosen et al., (2006) Nucleic Acids Res 34:4791-800; Chames et al., (2005) Nucleic Acids Res 33:e178; Smith et al., (2006) Nucleic Acids Res 34:e149; Gruen et al., (2002) Nucleic Acids Res 30:e29; Chen and Zhao, (2005) Nucleic Acids Res 33:e154; WO2005105989; WO2003078619; WO2006097854; WO2006097853; WO2006097784; and WO2004031346

Any meganuclease can be used herein, including, but not limited to, I-SceI, I-SceII, I-SceIII, I-SceIV, I-SceV, I-SceVI, I-SceVII, I-CeuI, I-CeuAIIP, I-CreI, I-CrepsbIP, I-CrepsbIIP, I-CrepsbIIIP, I-CrepsblVP, I-TliI, I-PpoI, PI-PspI, F-SceI, F-SceII, F-SuvI, F-TevI, F-TevII, I-AmaI, I-AniI, I-ChuI, I-CmoeI, I-CpaI, I-CpaII, I-CsmI, I-CvuI, I-CvuAIP, I-DdiI, I-DdiII, I-DirI, I-DmoI, I-HmuI, I-HmuII, I-HsNIP, I-LlaI, I-MsoI, I-NaaI, I-NanI, I-NcIIP, I-NgrIP, I-NitI, I-NjaI, I-Nsp236IP, I-PakI, I-PboIP, I-PcuIP, I-PcuAI, I-PcuVI, I-PgrIP, I-PobIP, I-PorI, I-PorIIP, I-PbpIP, I-SpBetaIP, I-ScaI, I-SexIP, I-SneIP, I-SpomI, I-SpomCP, I-SpomIP, I-SpomIIP, I-SquIP, I-Ssp6803I, I-SthPhiJP, I-SthPhiST3P, I-SthPhiSTe3bP, I-TdeIP, I-TevI, I-TevII, I-TevIII, I-UarAP, I-UarHGPAIP, I-UarHGPA13P, I-VinIP, I-ZbiIP, PI-MtuI, PI-MtuHIP PI-MtuHIIP, PI-PfuI, PI-PfuII, PI-PkoI, PI-PkoII, PI-Rma43812IP, PI-SpBetaIP, PI-SceI, PI-TfuI, PI-TfuII, PI-ThyI, PI-TliI, PI-TliII, or any active variants or fragments thereof. In a specific embodiment, the engineered endonuclease is derived from I-Cre-I having the sequence set forth in SEQ ID NO: 15, 21 or 26 or an active variant or fragment thereof.

TAL effector nucleases are a new class of sequence-specific nucleases that can be used to make double-strand breaks at specific target sequences in the genome of a plant or other organism. TAL effector nucleases are created by fusing a native or engineered transcription activator-like (TAL) effector, or functional part thereof, to the catalytic domain of an endonuclease, such as, for example, FokI. The unique, modular TAL effector DNA binding domain allows for the design of proteins with potentially any given DNA recognition specificity. Thus, the DNA binding domains of the TAL effector nucleases can be engineered to recognize specific DNA target sites and thus, used to make double-strand breaks at desired target sequences. See, WO 2010/079430; Morbitzer et al. (2010) PNAS 10.1073/pnas.1013133107; Scholze & Boch (2010) Virulence 1:428-432; Christian et al. Genetics (2010) 186:757-761; Li et al. (2010) Nuc. Acids Res. (2010) doi:10.1093/nar/gkq704; and Miller et al. (2011) Nature Biotechnology 29:143-148; all of which are herein incorporated by reference.

The term "meganuclease activity" as used herein refers to the ability of a meganuclease to cut at a desired recognition sequence and thus retain double-strand-break-inducing activity.

Figure 2:
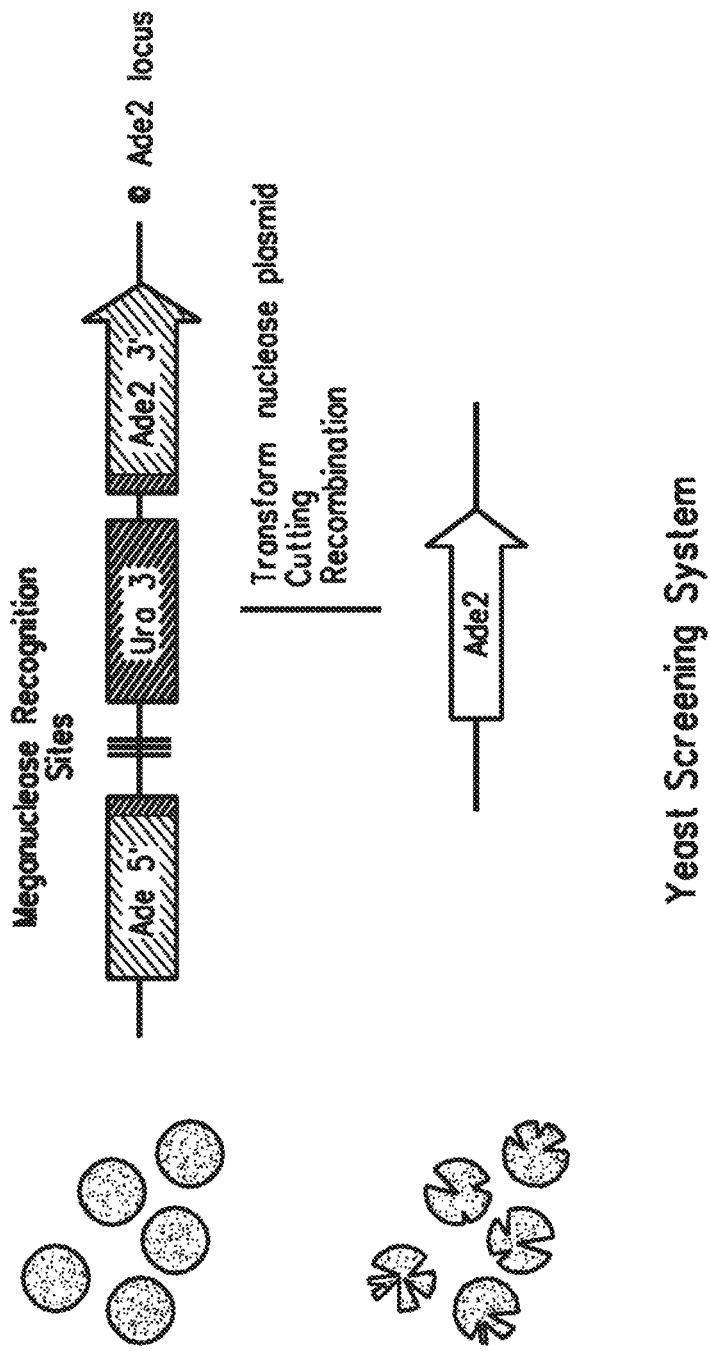
Figure 3:
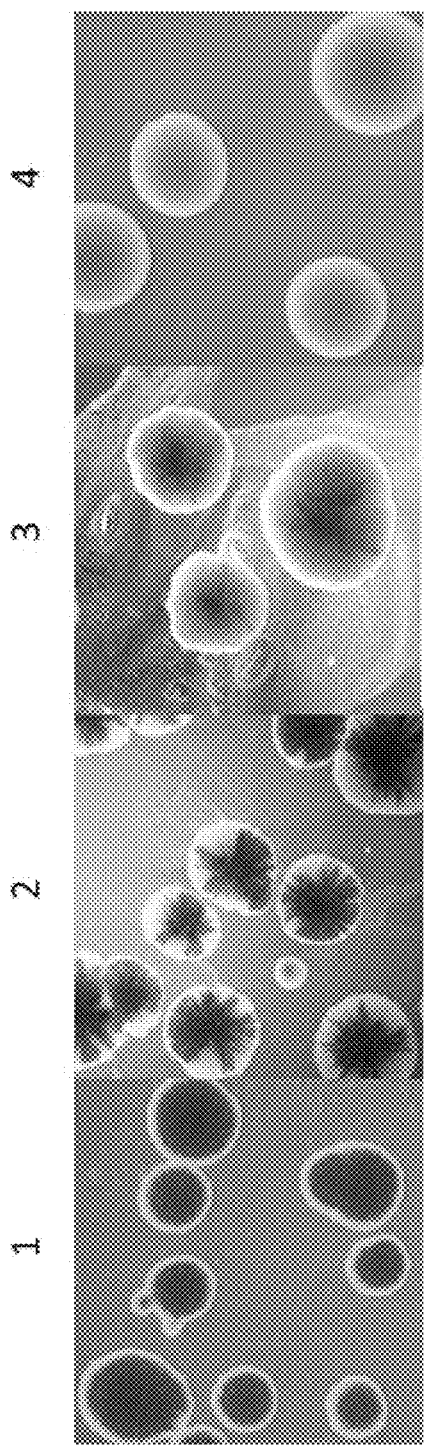

Assays for meganuclease activity are known and generally measure the overall activity and specificity of the meganuclease on DNA substrates containing the recognition site. For example, the meganuclease activity can be measured using a yeast screening assay as described herein. Yeast cells with a functional Ade2 gene are white, whereas those lacking Ade2 function exhibit red pigmentation due to accumulation of a metabolite earlier in the adenine biosynthetic pathway resulting in red colonies with white sectors as shown in FIGS. 2 and 3. The degree of white sectoring, sometimes extending to entire colonies, indicates the amount of meganuclease cutting activity. Since the sectoring phenotype is a qualitative measure of meganuclease activity, a 0-4 numerical scoring system was implemented. As shown in FIG. 3, a score of 0 indicates that no white sectors (no meganuclease cutting) were observed; a score of 4 indicates completely white colonies (complete cutting of the recognition site); scores of 1-3 indicate intermediate white sectoring phenotypes (and intermediate degrees of recognition site cutting). Meganuclease activity can also be measured in-vitro as described herein. In short, time-course digestions can be carried out on plasmid DNA containing the meganuclease recognition site at 37° C., 28° C., and 23° C. and the % digestion of each sample or loss of meganuclease recognition sites (indicative of meganuclease activity) can be determined by real-time PCR. Furthermore, meganuclease activity can be measured in-planta by determining the Target Site (TS) mutation rate. Target site mutation rate is defined as: (number of events with target site modification/total number events)*100%.

An "increased" or an "increased" activity are used interchangeably herein. An "increased" or "increased" meganuclease activity comprises any statistically significant increase in the activity of the parental meganuclease polypeptide as determined through any activity assays described herein.

The meganuclease can be provided via a polynucleotide encoding the endonuclease. Such a polynucleotide encoding an endonuclease can be modified to substitute codons having a higher frequency of usage in a plant, as compared to the naturally occurring polynucleotide sequence. For example the polynucleotide encoding the meganuclease can be modified to substitute codons having a higher frequency of usage in a maize or soybean plant, as compared to the naturally occurring polynucleotide sequence.

Various methods and compositions are provided which employ polynucleotides and polypeptides having meganuclease activity.

In one embodiment, the invention concerns an isolated or recombinant polynucleotide comprising a nucleotide sequence encoding a meganuclease polypeptide, said polypeptide comprising: a) an amino acid sequence having at least one amino acid modification at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; or, b) an amino acid sequence having at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 or 44 of any of the amino acid modification of (a).

In another embodiment, the invention concerns an isolated or recombinant polynucleotide of the current disclosure, and its corresponding polypeptide, wherein said nucleotide sequence encodes a meganuclease polypeptide, wherein said polypeptide further comprises at least one amino acid modification described herein such as those shown in FIG. 5A-FIG. 5E, FIG. 9A-FIG. 9N, FIG. 10A-FIG. 10D, FIG. 11, FIG. 12, FIG. 13, FIG. 14A-FIG. 14F and FIG. 15A-FIG. 15E as well any I-CreI type modification known and any combination thereof.

Further provided are methods and compositions which employ polynucleotides and polypeptides having increased meganuclease activity when compared to an appropriate control. Such meganuclease polypeptides include those set forth in any one of SEQ ID NOs:14-38 (LIG3-4 variants), SEQ ID NOs:87-167 (MHP77 variants, SEQ ID NOs: 251, 252, 253, 262 (MHP77.3 variants), SEQ ID NOs:272-275 (MS26+ variants), SEQ ID NOs:284-298 (MHP14 variants), SEQ ID NOs:315-320 (MHP14+ variants), SEQ ID NOs: 330-341 (MH107 variants), SEQ ID NOs:357-371 (ZM6.3 variants), SEQ ID NOs:390-403 (ZM6.22V2 variants) or SEQ ID NOs: 430-432 and biologically active variants thereof. Further provided are the polynucleotides encoding these various polypeptides and active variant thereof.

The term "Variant" protein is intended to mean a protein derived from the protein (referred to as parental protein) by deletion (i.e., truncation at the 5' and/or 3' end) and/or a deletion or addition of one or more amino acids at one or more internal sites in the parental protein and/or substitution of one or more amino acids at one or more sites in the parental protein. As used herein, a "parental" polynucleotide, polypeptide (protein) can result from human manipulation or from a native protein comprising a naturally occurring nucleotide sequence or amino acid sequence, respectively. Variant proteins encompassed are biologically active, that is they continue to possess the desired biological activity of the parental protein, that is, have meganuclease activity. Such variants may result from, for example, genetic polymorphism or from human manipulation.

The term "variant meganuclease" refers to a variant protein with meganuclease activity. The variant meganuclease is derived from a parental meganuclease wherein the variant meganuclease comprises at least one amino acid modification when compared to the parental meganuclease polypeptide.

Variant meganuclease polypeptides of the invention include those set forth in any one of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 262, 272, 273, 274, 275, 284, 285, 286, 287, 288, 289, 290, 291, 292, 293, 294, 295, 296, 297, 298, 315, 316, 317, 318, 319, 320, 330, 331, 332, 334, 335, 336, 337, 338, 339, 340, 341, 357, 358, 359, 360, 361, 362, 363, 364, 365, 366, 367, 368, 369, 370, 370, 371, 390, 391, 392, 393, 394, 395, 396, 397, 398, 399, 400, 401, 402, 403, 430, 431, 432 or 433 and biologically active variants and fragments thereof. Further provided are the polynucleotides encoding these various polypeptides and active variant and fragments thereof.

Any one of the amino acid modifications identified in Examples 3-23 can be transferred to a parental meganuclease to create a variant meganuclease. These meganucleases can be screened for increased activity by methods described herein.

One embodiment of the invention concerns the transfer of at least one amino acid modification selected from the group of Y12 to H, G19 to S or A, Q50 to K or R, F54 to I, D56 to L, V105 to A, E124 to R, V129 to A, I132 to V or T, D153 to M or L, V316 to A or I 319 to V to a parental meganuclease in order to improve the activity of the parental meganuclease. Another embodiment concern the transfer of 1, 2, 3, 4, 5, 6, 7, 8, 9, 10, 11, or 12 amino acid modification selected from the group of Y12 to H, G19 to S or A, Q50 to K or R, F54 to I, D56 to L, V105 to A, E124 to R, V129 to A, I132 to V or T, D153 to M or L, V316 to A or I 319 to V to a parental meganuclease in order to improve the activity of the parental meganuclease.

Any one of the modifications described herein can be combined with other known modifications of I-CreI type meganucleases.

As used herein with respect to a recombinant polynucleotide encoding a recombinant protein, term "modification" means any insertion, deletion or substitution of an amino acid residue in the recombinant protein sequence relative to a reference or control sequence.

"Variants" is intended to mean substantially similar sequences. For polynucleotides, conservative variants include those sequences that, because of the degeneracy of the genetic code, encode the amino acid sequence of one of the meganuclease polypeptides of the invention. Naturally occurring variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis or gene synthesis but which still encode a meganuclease polypeptide.

Biologically Active variants of meganucleases (i.e. variant meganucleases) are also provided. Variant meganucleases are biologically active variants of a meganuclease polypeptide (and the polynucleotide encoding the same) will have at least about 80%, 81%, 82%, 83%, 84%, 85%, 86%, 87%, 88%, 89%, 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5%, 99.6% or more sequence identity to the polypeptide of a control meganuclease, wherein the active variants retain the ability to cut at a desired recognition site. For example, any of the variant meganucleases described herein can be modified from a parental endonuclease sequence and designed to recognize and induce a double strand break at the same recognition site of the parental meganuclease. Thus in some embodiments, the variant meganuclease contains at least one amino acid modification when compared to the parental meganuclease and has a specificity to induce a double-strand break at the same recognition sequence as the corresponding parental meganuclease recognition sequence.

A "control meganuclease" or "reference meganuclease" can be used interchangeably and refers to any meganuclease to which a variant meganuclease is compared to. Control meganucleases can include, but are not limited to, parental or corresponding meganucleases or any wild-type I-Cre1 type meganucleases.

Numbering of an amino acid or nucleotide polymer, such any one of the meganucleases of the invention, corresponds to numbering of a selected amino acid polymer or nucleic acid when the position of a given monomer component (amino acid residue, incorporated nucleotide, etc.) of the polymer corresponds to the same residue position in a selected reference polypeptide or polynucleotide.

Further provided are biologically active variants of a meganuclease polypeptide (and the polynucleotide encoding the same) that will have at least about 80%, 81%, 82%, 83%, 84%, 85%, 86%, 87%, 88%, 89%, 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5%, 99.6% or more sequence identity to the polypeptide of any one of SEQ ID NO: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 262, 272, 273, 274, 275, 284, 285, 286, 287, 288, 289, 290, 291, 292, 293, 294, 295, 296, 297, 298, 315, 316, 317, 318, 319, 320, 330, 331, 332, 334, 335, 336, 337, 338, 339, 340, 341, 357, 358, 359, 360, 361, 362, 363, 364, 365, 366, 367, 368, 369, 370, 370, 371, 390, 391, 392, 393, 394, 395, 396, 397, 398, 399, 400, 401, 402, 403, 430, 431, 432 or 433 or with regard to any of the meganuclease polypeptides disclosed herein as determined by sequence alignment In one embodiment the variant meganuclease of the present invention comprises a linker polypeptide, wherein said linker polypeptide comprises: a) SEQ ID NO:420; b) SEQ ID NO:421; c) SEQ ID NO:422; or, d) an amino acid sequence consisting of any possible amino acid at positions corresponding to positions 156 to 193 of SEQ ID NO:1. It is also understood that these linker sequences can be substituted for any other linker sequence that links both I-Cre type monomers while still enabling the single polypeptide meganuclease to provide a double strand break at a target sequence.

As used herein, a "genomic region of interest" is a segment of a chromosome in the genome of a plant that is desirable for introducing a polynucleotide of interest or trait of interest. The genomic region of interest can include, for example, one or more polynucleotides of interest. Generally, a genomic region of interest of the present invention comprises a segment of chromosome that is 0-15 cM.

As used herein, a "polynucleotide of interest" within a genomic region of interest is any coding and/or non-coding portion of the genomic region of interest including, but not limited to, a transgene, a native gene, a mutated gene, and a genetic marker such as, for example, a single nucleotide polymorphism (SNP) marker and a simple sequence repeat (SSR) marker.

As used herein, "physically linked," "in physical linkage", and "genetically linked" are used to refer to any two or more genes, transgenes, native genes, mutated genes, alterations, target sites, markers, and the like that are part of the same DNA molecule or chromosome.

Sequence Comparisons

The following terms are used to describe the sequence relationships between two or more polynucleotides or polypeptides: (a) "reference sequence", (b) "comparison window", (c) "sequence identity", and, (d) "percent sequence identity."

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence or protein sequence.

(b) As used herein, "comparison window" makes reference to a contiguous and specified segment of a polypeptide sequence, wherein the polypeptide sequence in the comparison window may comprise additions or deletions (i.e., gaps) compared to the reference sequence (which does not comprise additions or deletions) for optimal alignment of the two polypeptides. Generally, the comparison window is at least 5, 10, 15, or 20 contiguous amino acid in length, or it can be 30, 40, 50, 100, or longer. Those of skill in the art understand that to avoid a high similarity to a reference sequence due to inclusion of gaps in the polypeptide sequence a gap penalty is typically introduced and is subtracted from the number of matches.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) CABIOS 4:11-17; the local alignment algorithm of Smith et al. (1981) Adv. Appl. Math. 2:482; the global alignment algorithm of Needleman and Wunsch (1970) J. Mol. Biol. 48:443-453; the search-for-local alignment method of Pearson and Lipman (1988) Proc. Natl. Acad. Sci. 85:2444-2448; the algorithm of Karlin and Altschul (1990) Proc. Natl. Acad. Sci. USA 872264, modified as in Karlin and Altschul (1993) Proc. Natl. Acad. Sci. USA 90:5873-5877. Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) Gene 73:237-244 (1988); Higgins et al. (1989) CABIOS 5:151-153; Corpet et al. (1988) Nucleic Acids Res. 16:10881-90; Huang et al. (1992) CABIOS 8:155-65; and Pearson et al. (1994) Meth. Mol. Biol. 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) J. Mol. Biol. 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. BLASTP protein searches can be performed using default parameters. See, blast.ncbi.nlm.nih.gov/Blast.cgi.

Sequence alignments and percent similarity calculations may be determined using the Megalign program of the LASARGENE bioinformatics computing suite (DNASTAR Inc., Madison, Wis.) or using the AlignX program of the Vector NTI bioinformatics computing suite (Invitrogen, Carlsbad, Calif.). Multiple alignment of the sequences are performed using the Clustal method of alignment (Higgins and Sharp, CABIOS 5:151-153 (1989)) with the default parameters (GAP PENALTY=10, GAP LENGTH PENALTY=10). Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are GAP PENALTY=10, GAP LENGTH PENALTY=10, KTUPLE=2, GAP PENALTY=5, WINDOW=4 and DIAGONALS SAVED=4. A "substantial portion" of an amino acid or nucleotide sequence comprises enough of the amino acid sequence of a polypeptide or the nucleotide sequence of a gene to afford putative identification of that polypeptide or gene, either by manual evaluation of the sequence by one skilled in the art, or by computer-automated sequence comparison and identification using algorithms such as BLAST (Altschul, S. F. et al., J. Mol. Biol. 215:403-410 (1993)) and Gapped Blast (Altschul, S. F. et al., Nucleic Acids Res. 25:3389-3402 (1997)). BLASTN refers to a BLAST program that compares a nucleotide query sequence against a nucleotide sequence database.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" or "recombinant expression construct", which are used interchangeably, refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

"Coding sequence" refers to a DNA sequence which codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, and polyadenylation recognition sequences.

"Codon degeneracy" refers to divergence in the genetic code permitting variation of the nucleotide sequence without affecting the amino acid sequence of an encoded polypeptide. Accordingly, the instant invention relates to any nucleic acid fragment comprising a nucleotide sequence that encodes all or a substantial portion of the amino acid sequences set forth herein. The skilled artisan is well aware of the "codon-bias" exhibited by a specific host cell in usage of nucleotide codons to specify a given amino acid. Therefore, when synthesizing a nucleic acid fragment for increased expression in a host cell, it is desirable to design the nucleic acid fragment such that its frequency of codon usage approaches the frequency of preferred codon usage of the host cell.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity). When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percent sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

As used herein, "percent sequence identity" means the value determined by comparing two aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percent sequence identity.

Polynucleotide Constructs

Provided herein are polynucleotides or nucleic acid molecules comprising the meganucleases or any active variants or fragments thereof. The terms "polynucleotide," "polynucleotide sequence," "nucleic acid sequence," and "nucleic acid fragment" are used interchangeably herein. These terms encompass nucleotide sequences and the like. The use of the term "polynucleotide" is not intended to limit the present invention to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the invention also encompass all forms of sequences including, but not limited to, single-stranded forms, double-stranded forms, hairpins, stem-and-loop structures, and the like.

Further provided are recombinant polynucleotides comprising the various meganucleases. The terms "recombinant polynucleotide", "recombinant nucleotide", "recombinant DNA" and "recombinant DNA construct" are used interchangeably herein. A recombinant construct comprises an artificial or heterologous combination of nucleic acid sequences, e.g., regulatory and coding sequences that are not found together in nature. For example, a transfer cassette can comprise restriction sites and a heterologous polynucleotide of interest. In other embodiments, a recombinant construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments provided herein. The skilled artisan will also recognize that different independent transformation events will result in different levels and patterns of expression (Jones et al., EMBO J. 4:2411-2418 (1985); De Almeida et al., Mol. Gen. Genetics 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The meganuclease polynucleotides disclosed herein can be provided in expression cassettes for expression in the plant of interest. The cassette can include 5' and 3' regulatory sequences operably linked to an meganuclease polynucleotide or active variant or fragment thereof. "Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions, by operably linked is intended that the coding regions are in the same reading frame. The cassette may additionally contain at least one additional gene to be cotransformed into the organism. Alternatively, the additional gene(s) can be provided on multiple expression cassettes. Such an expression cassette is provided with a plurality of restriction sites and/or recombination sites for insertion of the meganuclease polynucleotide or active variant or fragment thereof to be under the transcriptional regulation of the regulatory regions. The expression cassette may additionally contain selectable marker genes.

The expression cassette can include in the 5'-3' direction of transcription, a transcriptional and translational initiation region (i.e., a promoter), a meganuclease polynucleotide or active variant or fragment thereof, and a transcriptional and translational termination region (i.e., termination region) functional in plants. The regulatory regions (i.e., promoters, transcriptional regulatory regions, and translational termination regions) and/or the meganuclease polynucleotide or active variant or fragment thereof may be native/analogous to the host cell or to each other. Alternatively, the regulatory regions and/or the meganuclease polynucleotide of or active variant or fragment thereof may be heterologous to the host cell or to each other.

As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide.

While it may be optimal to express the sequences using heterologous promoters, the native promoter sequences may be used. Such constructs can change expression levels of the meganuclease polynucleotide in the plant or plant cell. Thus, the phenotype of the plant or plant cell can be altered.

The termination region may be native with the transcriptional initiation region, may be native with the operably linked meganuclease polynucleotide or active variant or fragment thereof, may be native with the plant host, or may be derived from another source (i.e., foreign or heterologous) to the promoter, the meganuclease polynucleotide or active fragment or variant thereof, the plant host, or any combination thereof. Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Where appropriate, the polynucleotides may be optimized for increased expression in the transformed plant. That is, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86:6126-6130); potyvirus leaders, for example, TEV leader (Tobacco Etch Virus) (Gallie et al. (1995) *Gene* 165(2):233-238), MDMV leader (Maize Dwarf Mosaic Virus) (*Virology* 154:9-20), and human immunoglobulin heavy-chain binding protein (BiP) (Macejak et al. (1991) *Nature* 353:90-94); untranslated leader from the coat protein mRNA of alfalfa mosaic virus (AMV RNA 4) (Jobling et al. (1987) *Nature* 325:622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81:382-385. See also, Della-Cioppa et al. (1987) *Plant Physiol.* 84:965-968.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used to express the various meganuclease sequence disclosed herein, including the native promoter of the polynucleotide sequence of interest. The promoters can be selected based on the desired outcome. Such promoters include, for example, constitutive, tissue-preferred, or other promoters for expression in plants.

Constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced meganuclease expression within a particular plant tissue. Tissue-preferred promoters include those described in Yamamoto et al. (1997) *Plant J.* 12(2):255-265; Kawamata et al. (1997) *Plant Cell Physiol.* 38(7):792-803; Hansen et al. (1997) *Mol. Gen. Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol. Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Synthetic promoters can be used to express meganuclease sequences or biologically active variants and fragments thereof.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glyphosate, glufosinate ammonium, bromoxynil, sulfonylureas, dicamba, and 2,4-dichlorophenoxyacetate (2,4-D). Additional selectable markers include phenotypic markers such as β-galactosidase and fluorescent proteins such as green fluorescent protein (GFP) (Su et al. (2004) *Biotechnol Bioeng* 85:610-9 and Fetter et al. (2004) *Plant Cell* 16:215-28), cyan florescent protein (CYP) (Bolte et al. (2004) *J. Cell Science* 117:943-54 and Kato et al. (2002) *Plant Physiol* 129:913-42), and yellow florescent protein (PhiYFP™ from Evrogen, see, Bolte et al. (2004) *J. Cell Science* 117:943-54). For additional selectable markers, see generally, Yarranton (1992) *Curr. Opin. Biotech.* 3:506-511; Christopherson et al. (1992) *Proc. Natl. Acad. Sci. USA* 89:6314-6318; Yao et al. (1992) *Cell* 71:63-72; Reznikoff (1992) *Mol. Microbiol.* 6:2419-2422; Barkley et al. (1980) in *The Operon*, pp. 177-220; Hu et al. (1987) *Cell* 48:555-566; Brown et al. (1987) *Cell* 49:603-612; Figge et al. (1988) *Cell* 52:713-722; Deuschle et al. (1989) *Proc. Natl. Acad. Aci. USA* 86:5400-5404; Fuerst et al. (1989) *Proc. Natl. Acad. Sci. USA* 86:2549-2553; Deuschle et al. (1990) *Science* 248:480-483; Gossen (1993) Ph.D. Thesis, University of Heidelberg; Reines et al. (1993) *Proc. Natl. Acad. Sci. USA* 90:1917-1921; Labow et al. (1990) *Mol. Cell. Biol.* 10:3343-3356; Zambretti et al. (1992) *Proc. Natl. Acad. Sci. USA* 89:3952-3956; Baim et al. (1991) *Proc. Natl. Acad. Sci. USA* 88:5072-5076; Wyborski et al. (1991) *Nucleic Acids Res.* 19:4647-4653; Hillenand-Wissman (1989) *Topics Mol. Struc. Biol.* 10:143-162; Degenkolb et al. (1991) *Antimicrob. Agents Chemother.*

35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology*, Vol. 78 (Springer-Verlag, Berlin); Gill et al. (1988) *Nature* 334:721-724. Such disclosures are herein incorporated by reference. The above list of selectable marker genes is not meant to be limiting. Any selectable marker gene can be used in the present invention.

Method of Introducing

The meganuclease may be introduced by any means known in the art. For example, a cell, yeast or plant having the recognition site in its genome is provided. The meganuclease may be transiently expressed or the polypeptide itself can be directly provided to the cell. Alternatively, a nucleotide sequence capable of expressing the meganuclease may be stably integrated into the genome of the plant. In the presence of the corresponding recognition site and the meganuclease, a donor DNA can be inserted into the transformed plant's genome. Alternatively, the different components may be brought together by sexually crossing transformed plants. Thus a sequence encoding a meganuclease and/or target site can be sexually crossed to one another to allow each component of the system to be present in a single plant. The meganuclease may be under the control of a constitutive or inducible promoter. Such promoters of interest are discussed in further detail elsewhere herein.

Various methods can be used to introduce a sequence of interest such as, any of the meganuclease of the invention, into a plant or plant part. "Introducing" is intended to mean presenting to the plant, plant cell or plant part the polynucleotide or polypeptide in such a manner that the sequence gains access to the interior of a cell of the plant. The methods of the invention do not depend on a particular method for introducing a sequence into a plant or plant part, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof "Transient transformation" is intended to mean that a polynucleotide is introduced into the plant and does not integrate into the genome of the plant or a polypeptide is introduced into a plant.

Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. No. 5,563, 055 and U.S. Pat. No. 5,981,840), direct gene transfer (Paszkowski et al. (1984) *EMBO J.* 3:2717-2722), and ballistic particle acceleration (see, for example, U.S. Pat. No. 4,945,050; U.S. Pat. No. 5,879,918; U.S. Pat. No. 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

In specific embodiments, the meganuclease sequences or active variant or fragments thereof can be provided to a yeast cell or plant using a variety of transient transformation methods. Such transient transformation methods include, but are not limited to, the introduction of the meganuclease protein or active variants and fragments thereof directly into a yeast cell or plant. Such methods include, for example, microinjection or particle bombardment. See, for example, Crossway et al. (1986) *Mol. Gen. Genet.* 202:179-185; Nomura et al. (1986) *Plant Sci.* 44:53-58; Hepler et al. (1994) *Proc. Natl. Acad. Sci.* 91: 2176-2180 and Hush et al. (1994) *The Journal of Cell Science* 107:775-784, all of which are herein incorporated by reference.

In other embodiments, the polynucleotide of the invention may be introduced into yeast cells or plants by contacting plants with a virus or viral nucleic acids. Generally, such methods involve incorporating a nucleotide construct of the invention within a DNA or RNA molecule. It is recognized that the an meganuclease sequence may be initially synthesized as part of a viral polyprotein, which later may be processed by proteolysis in vivo or in vitro to produce the desired recombinant protein. Further, it is recognized that promoters of the invention also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316, 931, and Porta et al. (1996) *Molecular Biotechnology* 5:209-221; herein incorporated by reference.

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the invention can be contained in transfer cassette flanked by two non-recombinogenic recombination sites. The transfer cassette is introduced into a plant having stably incorporated into its genome a target site which is flanked by two non-recombinogenic recombination sites that correspond to the sites of the transfer cassette. An appropriate recombinase is provided and the transfer cassette is integrated at the target site. The polynucleotide of interest is thereby integrated at a specific chromosomal position in the plant genome. Other methods to target polynucleotides are set forth in WO 2009/114321 (herein incorporated by reference), which describes "custom" meganucleases produced to modify plant genomes, in particular the genome of maize. See, also, Gao et al. (2010) *Plant Journal* 1:176-187.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide of the invention, for example, an expression cassette of the invention, stably incorporated into their genome.

Method of Detections

Methods for detecting a meganuclease polypeptide or an active variant or fragment thereof are provided. Such methods comprise analyzing plant tissues to detect such polypeptides or the polynucleotides encoding the same. The detection methods can directly assay for the presence of the meganuclease polypeptide or polynucleotide or the detection methods can indirectly assay for the sequences by assaying the phenotype of the cell, yeast, plant, plant cell or plant explant expressing the sequence.

In still other embodiments, the meganuclease polypeptide or active variant or fragment thereof can be detected in a plant tissue by detecting the presence of a polynucleotide encoding any of the various meganuclease polypeptides or active variants and fragments thereof. In one embodiment, the detection method comprises assaying plant tissue using PCR amplification.

As used herein, "primers" are isolated polynucleotides that are annealed to a complementary target DNA strand by nucleic acid hybridization to form a hybrid between the primer and the target DNA strand, then extended along the target DNA strand by a polymerase, e.g., a DNA polymerase. Primer pairs of the invention refer to their use for amplification of a target polynucleotide, e.g., by the polymerase chain reaction (PCR) or other conventional nucleic-acid amplification methods. "PCR" or "polymerase chain reaction" is a technique used for the amplification of specific DNA segments (see, U.S. Pat. Nos. 4,683,195 and 4,800,159; herein incorporated by reference).

Probes and primers are of sufficient nucleotide length to bind to the target DNA sequence and specifically detect and/or identify a polynucleotide encoding a meganuclease polypeptide or active variant or fragment thereof as describe elsewhere herein. It is recognized that the hybridization conditions or reaction conditions can be determined by the operator to achieve this result. This length may be of any length that is of sufficient length to be useful in a detection method of choice. Such probes and primers can hybridize specifically to a target sequence under high stringency hybridization conditions. Probes and primers according to embodiments of the present invention may have complete DNA sequence identity of contiguous nucleotides with the target sequence, although probes differing from the target DNA sequence and that retain the ability to specifically detect and/or identify a target DNA sequence may be designed by conventional methods. Accordingly, probes and primers can share about 80%, 85%, 90%, 91%, 92%, 93%, 94%, 95%, 96%, 97%, 98%, 99% or greater sequence identity or complementarity to the target polynucleotide.

Methods for preparing and using probes and primers are described, for example, in *Molecular Cloning: A Laboratory Manual*, 2.sup. nd ed, vol. 1-3, ed. Sambrook et al., Cold Spring Harbor Laboratory Press, Cold Spring Harbor, N.Y. 1989 (hereinafter, "Sambrook et al., 1989"); *Current Protocols in Molecular Biology*, ed. Ausubel et al., Greene Publishing and Wiley-Interscience, New York, 1992 (with periodic updates) (hereinafter, "Ausubel et al., 1992"); and Innis et al., PCR Protocols: A Guide to Methods and Applications, Academic Press: San Diego, 1990. PCR primer pairs can be derived from a known sequence, for example, by using computer programs intended for that purpose such as the PCR primer analysis tool in Vector NTI version 10 (Invitrogen); PrimerSelect (DNASTAR Inc., Madison, Wis.); and Primer (Version 0.5.COPYRGT., 1991, Whitehead Institute for Biomedical Research, Cambridge, Mass.). Additionally, the sequence can be visually scanned and primers manually identified using guidelines known to one of skill in the art.

Method of Identifying Meganuclease Variants.

Various methods can be employed to identify further meganuclease variants. The polynucleotides of the invention are optionally used as substrates for a variety of diversity generating procedures, e.g., mutation, recombination and recursive recombination reactions, in addition to their use in standard cloning methods as set forth in, e.g., Ausubel, Berger and Sambrook, i.e., to produce additional meganuclease polynucleotides and polypeptides with desired properties. A variety of diversity generating protocols can be used. The procedures can be used separately, and/or in combination to produce one or more variants of a polynucleotide or set of polynucleotides, as well variants of encoded proteins. Individually and collectively, these procedures provide robust, widely applicable ways of generating diversified polynucleotides and sets of polynucleotides (including, e.g., polynucleotide libraries) useful, e.g., for the engineering or rapid evolution of polynucleotides, proteins, pathways, cells and/or organisms with new and/or improved characteristics. The process of altering the sequence can result in, for example, single nucleotide substitutions, multiple nucleotide substitutions, and insertion or deletion of regions of the nucleic acid sequence.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The terms "diversification" and "diversity," as applied to a polynucleotide, refers to generation of a plurality of modified forms of a parental polynucleotide, or plurality of parental polynucleotides. In the case where the polynucleotide encodes a polypeptide, diversity in the nucleotide sequence of the polynucleotide can result in diversity in the corresponding encoded polypeptide, e.g. a diverse pool of polynucleotides encoding a plurality of polypeptide variants. In some embodiments of the invention, this sequence diversity is exploited by screening/selecting a library of diversified polynucleotides for variants with desirable functional attributes, e.g., a polynucleotide encoding a meganuclease with enhanced functional characteristics.

The result of any of the diversity generating procedures described herein can be the generation of one or more polynucleotides, which can be selected or screened for polynucleotides that encode proteins with or which confer desirable properties. Following diversification by one or more of the methods herein, or otherwise available to one of skill, any polynucleotides that are produced can be selected for a desired activity or property, e.g. altered Km, use of alternative cofactors, increased kcat, etc. This can include identifying any activity that can be detected, for example, in an automated or automatable format, by any of the assays in the art. For example, modified meganuclease polypeptides can be detected by assaying for a meganuclease activity. Assays to measure such activity are described elsewhere herein. A variety of related (or even unrelated) properties can be evaluated, in serial or in parallel, at the discretion of the practitioner.

Descriptions of a variety of diversity generating procedures, including family shuffling and methods for generating modified nucleic acid sequences encoding multiple enzymatic domains, are found in the following publications and the references cited therein: Soong N. et al. (2000) *Nat Genet.* 25(4):436-39; Stemmer et al. (1999) *Tumor Targeting* 4:1-4; Ness et al. (1999) *Nature Biotechnology* 17:893-896; Chang et al. (1999) *Nature Biotechnology* 17:793-797; Minshull and Stemmer (1999) *Current Opinion in Chemical Biology* 3:284-290; Christians et al. (1999) *Nature Biotechnology* 17:259-264; Crameri et al. (1998) *Nature* 391:288-291; Crameri et al. (1997) *Nature Biotechnology* 15:436-438; Zhang et al. (1997) *Proc. Natl. Acad. Sci. USA* 94:4504-4509; Patten et al. (1997) *Current Opinion in Biotechnology* 8:724-733; Crameri et al. (1996) *Nature Medicine* 2:100-103; Crameri et al. (1996) *Nature Biotechnology* 14:315-319; Gates et al. (1996) *Journal of Molecular Biology* 255:373-386; Stemmer (1996) "Sexual PCR and Assembly PCR" In: The Encyclopedia of Molecular Biology. VCH Publishers, New York. pp. 447-457; Crameri and Stemmer (1995) *BioTechniques* 18:194-195; Stemmer et al. (1995) *Gene:* 164:49-53; Stemmer (1995) *Science* 270: 1510; Stemmer (1995) *Bio/Technology* 13:549-553; Stemmer (1994) *Nature* 370:389-391; and Stemmer (1994) *Proc. Natl. Acad. Sci. USA* 91:10747-10751. See also WO2008/073877 and US 20070204369, both of which are herein incorporated by reference in their entirety.

Mutational methods of generating diversity include, for example, site-directed mutagenesis (Ling et al. (1997) *Anal Biochem.* 254(2): 157-178; Dale et al. (1996) *Methods Mol. Biol.* 57:369-374; Smith (1985) *Ann. Rev. Genet.* 19:423-462; Botstein & Shortle (1985) *Science* 229:1193-1201; Carter (1986) *Biochem. J.* 237:1-7; and Kunkel (1987) Nucleic Acids & Molecular Biology (Eckstein, F. and Lilley, D. M. J. eds., Springer Verlag, Berlin)); mutagenesis using uracil containing templates (Kunkel (1985) *Proc. Natl. Acad. Sci. USA* 82:488-492; Kunkel et al. (1987) *Methods in Enzymol.* 154, 367-382; and Bass et al. (1988) *Science* 242:240-245); oligonucleotide-directed mutagenesis (*Methods in Enzymol.* 100: 468-500 (1983); *Methods in Enzymol.* 154: 329-350 (1987); Zoller & Smith (1982) *Nucleic Acids Res.* 10:6487-6500; Zoller & Smith (1983) *Methods in Enzymol.* 100:468-500; and Zoller & Smith (1987) *Methods in Enzymol.* 154:329-350); phosphorothioate-modified DNA mutagenesis (Taylor et al. (1985) *Nucl. Acids Res.* 13: 8749-8764; Taylor et al. (1985) *Nucl. Acids Res.* 13: 8765-8787 (1985); Nakamaye & Eckstein (1986) *Nucl. Acids Res.* 14: 9679-9698; Sayers et al. (1988) *Nucl. Acids Res.* 16:791-802; and Sayers et al. (1988) *Nucl. Acids Res.* 16: 803-814); mutagenesis using gapped duplex DNA (Kramer et al. (1984) *Nucl. Acids Res.* 12: 9441-9456; Kramer & Fritz (1987) *Methods in Enzymol.* 154:350-367; Kramer et al. (1988) *Nucl. Acids Res.* 16: 7207; and Fritz et al. (1988) *Nucl. Acids Res.* 16: 6987-6999).

Additional suitable methods include, but are not limited to, point mismatch repair (Kramer et al. (1984) *Cell* 38:879-887), mutagenesis using repair-deficient host strains (Carter et al. (1985) *Nucl. Acids Res.* 13: 4431-4443; and Carter (1987) *Methods in Enzymol.* 154: 382-403), deletion mutagenesis (Eghtedarzadeh & Henikoff (1986) *Nucl. Acids Res.* 14: 5115), restriction-selection and restriction-purification (Wells et al. (1986) *Phil. Trans. R. Soc. Lond. A* 317: 415-423), mutagenesis by total gene synthesis (Nambiar et al. (1984) Science 223: 1299-1301; Sakamar and Khorana (1988) *Nucl. Acids Res.* 14: 6361-6372; Wells et al. (1985) *Gene* 34:315-323; and Grundstrom et al. (1985) *Nucl. Acids Res.* 13: 3305-3316), and double-strand break repair (Mandecki (1986); Arnold (1993) *Current Opinion in Biotechnology* 4:450-455 and *Proc. Natl. Acad. Sci. USA,* 83:7177-7181). Additional details on many of the above methods can be found in *Methods in Enzymology* Volume 154, which also describes useful controls for trouble-shooting problems with various mutagenesis methods.

Additional details regarding various diversity generating methods can be found in the following U.S. patents, PCT publications, and EPO publications: U.S. Pat. No. 5,605,793, U.S. Pat. No. 5,811,238, U.S. Pat. No. 5,830,721, U.S. Pat. No. 5,834,252, U.S. Pat. No. 5,837,458, WO 95/22625, WO 96/33207, WO 97/20078, WO 97/35966, WO 99/41402, WO 99/41383, WO 99/41369, WO 99/41368, EP 752008, EP 0932670, WO 99/23107, WO 99/21979, WO 98/31837, WO 98/27230, WO 98/13487, WO 00/00632, WO 00/09679, WO 98/42832, WO 99/29902, WO 98/41653, WO 98/41622, WO 98/42727, WO 00/18906, WO 00/04190, WO 00/42561, WO 00/42559, WO 00/42560, WO 01/23401, and, PCT/US01/06775. See, also WO20074303, herein incorporated by reference.

In brief, several different general classes of sequence modification methods, such as mutation, recombination, etc. are applicable to the present invention and set forth, e.g., in the references above. That is, alterations to the component nucleic acid sequences to produced modified gene fusion constructs can be performed by any number of the protocols described, either before cojoining of the sequences, or after the cojoining step. The following exemplify some of the different types of preferred formats for diversity generation in the context of the present invention, including, e.g., certain recombination based diversity generation formats.

Nucleic acids can be recombined in vitro by any of a variety of techniques discussed in the references above, including e.g., DNAse digestion of nucleic acids to be recombined followed by ligation and/or PCR reassembly of the nucleic acids. For example, sexual PCR mutagenesis can be used in which random (or pseudo random, or even non-random) fragmentation of the DNA molecule is followed by recombination, based on sequence similarity, between DNA molecules with different but related DNA sequences, in vitro, followed by fixation of the crossover by extension in a polymerase chain reaction. This process and many process variants are described in several of the references above, e.g., in Stemmer (1994) *Proc. Natl. Acad. Sci. USA* 91:10747-10751.

Similarly, nucleic acids can be recursively recombined in vivo, e.g., by allowing recombination to occur between nucleic acids in cells. Many such in vivo recombination formats are set forth in the references noted above. Such formats optionally provide direct recombination between nucleic acids of interest, or provide recombination between vectors, viruses, plasmids, etc., comprising the nucleic acids of interest, as well as other formats. Details regarding such procedures are found in the references noted above.

Whole genome recombination methods can also be used in which whole genomes of cells or other organisms are recombined, optionally including spiking of the genomic recombination mixtures with desired library components (e.g., genes corresponding to the pathways of the present invention). These methods have many applications, including those in which the identity of a target gene is not known. Details on such methods are found, e.g., in WO 98/31837 and in PCT/US99/15972. Thus, any of these processes and techniques for recombination, recursive recombination, and whole genome recombination, alone or in combination, can be used to generate the modified nucleic acid sequences and/or modified gene fusion constructs of the present invention.

Synthetic recombination methods can also be used, in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561, WO 01/23401, WO 00/42560, and, WO 00/42559.

In silico methods of recombination can be affected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis/gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on cross-over site selection) as well as designed, pseudorandom or random recombination methods are described in WO 00/42560 and WO 00/42559.

Many methods of accessing natural diversity, e.g., by hybridization of diverse nucleic acids or nucleic acid fragments to single-stranded templates, followed by polymerization and/or ligation to regenerate full-length sequences, optionally followed by degradation of the templates and recovery of the resulting modified nucleic acids can be similarly used. In one method employing a single-stranded template, the fragment population derived from the genomic library(ies) is annealed with partial, or, often approximately full length ssDNA or RNA corresponding to the opposite strand. Assembly of complex chimeric genes from this population is then mediated by nuclease-base removal of non-hybridizing fragment ends, polymerization to fill gaps between such fragments and subsequent single stranded ligation. The parental polynucleotide strand can be removed by digestion (e.g., if RNA or uracil-containing), magnetic separation under denaturing conditions (if labeled in a manner conducive to such separation) and other available separation/purification methods. Alternatively, the parental strand is optionally co-purified with the chimeric strands and removed during subsequent screening and processing steps. Additional details regarding this approach are found, e.g., in PCT/US01/06775.

In another approach, single-stranded molecules are converted to double-stranded DNA (dsDNA) and the dsDNA molecules are bound to a solid support by ligand-mediated binding. After separation of unbound DNA, the selected DNA molecules are released from the support and introduced into a suitable host cell to generate a library enriched sequences which hybridize to the probe. A library produced in this manner provides a desirable substrate for further diversification using any of the procedures described herein.

Any of the preceding general recombination formats can be practiced in a reiterative fashion (e.g., one or more cycles of mutation/recombination or other diversity generation methods, optionally followed by one or more selection methods) to generate a more diverse set of recombinant nucleic acids.

Mutagenesis employing polynucleotide chain termination methods have also been proposed (see e.g., U.S. Pat. No. 5,965,408 and the references above), and can be applied to the present invention. In this approach, double stranded DNAs corresponding to one or more genes sharing regions of sequence similarity are combined and denatured, in the presence or absence of primers specific for the gene. The single stranded polynucleotides are then annealed and incubated in the presence of a polymerase and a chain terminating reagent (e.g., ultraviolet, gamma or X-ray irradiation; ethidium bromide or other intercalators; DNA binding proteins, such as single strand binding proteins, transcription activating factors, or histones; polycyclic aromatic hydrocarbons; trivalent chromium or a trivalent chromium salt; or abbreviated polymerization mediated by rapid thermocycling; and the like), resulting in the production of partial duplex molecules. The partial duplex molecules, e.g., containing partially extended chains, are then denatured and reannealed in subsequent rounds of replication or partial replication resulting in polynucleotides which share varying degrees of sequence similarity and which are diversified with respect to the starting population of DNA molecules. Optionally, the products, or partial pools of the products, can be amplified at one or more stages in the process. Polynucleotides produced by a chain termination method, such as described above, are suitable substrates for any other described recombination format.

Diversity also can be generated in nucleic acids or populations of nucleic acids using a recombinational procedure termed "incremental truncation for the creation of hybrid enzymes" ("ITCHY") described in Ostermeier et al. (1999) *Nature Biotech* 17:1205. This approach can be used to generate an initial a library of variants which can optionally serve as a substrate for one or more in vitro or in vivo recombination methods. See, also, Ostermeier et al. (1999) *Proc. Natl. Acad. Sci. USA,* 96: 3562-67; Ostermeier et al. (1999), *Biological and Medicinal Chemistry* 7: 2139-44.

Mutational methods which result in the alteration of individual nucleotides or groups of contiguous or non-contiguous nucleotides can be favorably employed to introduce nucleotide diversity into the nucleic acid sequences and/or gene fusion constructs of the present invention. Many mutagenesis methods are found in the above-cited references; additional details regarding mutagenesis methods can be found in following, which can also be applied to the present invention.

For example, error-prone PCR can be used to generate nucleic acid variants. Using this technique, PCR is performed under conditions where the copying fidelity of the DNA polymerase is low, such that a high rate of point mutations is obtained along the entire length of the PCR product. Examples of such techniques are found in the references above and, e.g., in Leung et al. (1989) *Technique* 1:11-15 and Caldwell et al. (1992) *PCR Methods Applic.* 2:28-33. Similarly, assembly PCR can be used, in a process which involves the assembly of a PCR product from a mixture of small DNA fragments. A large number of different PCR reactions can occur in parallel in the same reaction mixture, with the products of one reaction priming the products of another reaction.

Oligonucleotide directed mutagenesis can be used to introduce site-specific mutations in a nucleic acid sequence of interest. Examples of such techniques are found in the references above and, e.g., in Reidhaar-Olson et al. (1988) *Science* 241:53-57. Similarly, cassette mutagenesis can be used in a process that replaces a small region of a double stranded DNA molecule with a synthetic oligonucleotide cassette that differs from the native sequence. The oligonucleotide can contain, e.g., completely and/or partially randomized native sequence(s).

Recursive ensemble mutagenesis is a process in which an algorithm for protein mutagenesis is used to produce diverse populations of phenotypically related mutants, members of which differ in amino acid sequence. This method uses a feedback mechanism to monitor successive rounds of combinatorial cassette mutagenesis. Examples of this approach are found in Arkin & Youvan (1992) *Proc. Natl. Acad. Sci. USA* 89:7811-7815.

Exponential ensemble mutagenesis can be used for generating combinatorial libraries with a high percentage of unique and functional mutants. Small groups of residues in a sequence of interest are randomized in parallel to identify, at each altered position, amino acids which lead to functional proteins. Examples of such procedures are found in Delegrave & Youvan (1993) *Biotechnology Research* 11:1548-1552.

In vivo mutagenesis can be used to generate random mutations in any cloned DNA of interest by propagating the DNA, e.g., in a strain of *E. coli* that carries mutations in one or more of the DNA repair pathways. These "mutator" strains have a higher random mutation rate than that of a wild-type parent. Propagating the DNA in one of these strains will eventually generate random mutations within the DNA. Such procedures are described in the references noted above.

Other procedures for introducing diversity into a genome, e.g. a bacterial, fungal, animal or plant genome can be used in conjunction with the above described and/or referenced methods. For example, in addition to the methods above, techniques have been proposed which produce nucleic acid multimers suitable for transformation into a variety of species (see, e.g., U.S. Pat. No. 5,756,316 and the references above). Transformation of a suitable host with such multimers, consisting of genes that are divergent with respect to one another, (e.g., derived from natural diversity or through application of site directed mutagenesis, error prone PCR, passage through mutagenic bacterial strains, and the like), provides a source of nucleic acid diversity for DNA diversification, e.g., by an in vivo recombination process as indicated above.

Alternatively, a multiplicity of monomeric polynucleotides sharing regions of partial sequence similarity can be transformed into a host species and recombined in vivo by the host cell. Subsequent rounds of cell division can be used to generate libraries, members of which, include a single, homogenous population, or pool of monomeric polynucleotides. Alternatively, the monomeric nucleic acid can be recovered by standard techniques, e.g., PCR and/or cloning, and recombined in any of the recombination formats, including recursive recombination formats, described above.

Methods for generating multispecies expression libraries have been described (in addition to the reference noted above, see, e.g., U.S. Pat. No. 5,783,431 and U.S. Pat. No. 5,824,485) and their use to identify protein activities of interest has been proposed (In addition to the references noted above, see, U.S. Pat. No. 5,958,672. Multispecies expression libraries include, in general, libraries comprising cDNA or genomic sequences from a plurality of species or strains, operably linked to appropriate regulatory sequences, in an expression cassette. The cDNA and/or genomic sequences are optionally randomly ligated to further enhance diversity. The vector can be a shuttle vector suitable for transformation and expression in more than one species of host organism, e.g., bacterial species, eukaryotic cells. In some cases, the library is biased by preselecting sequences which encode a protein of interest, or which hybridize to a nucleic acid of interest. Any such libraries can be provided as substrates for any of the methods herein described.

The above described procedures have been largely directed to increasing nucleic acid and/or encoded protein diversity. However, in many cases, not all of the diversity is useful, e.g., functional, and contributes merely to increasing the background of variants that must be screened or selected to identify the few favorable variants. In some applications, it is desirable to preselect or prescreen libraries (e.g., an amplified library, a genomic library, a cDNA library, a normalized library, etc.) or other substrate nucleic acids prior to diversification, e.g., by recombination-based mutagenesis procedures, or to otherwise bias the substrates towards nucleic acids that encode functional products. For example, in the case of antibody engineering, it is possible to bias the diversity generating process toward antibodies with functional antigen binding sites by taking advantage of in vivo recombination events prior to manipulation by any of the described methods. For example, recombined CDRs derived from B cell cDNA libraries can be amplified and assembled into framework regions (e.g., Jirholt et al. (1998) *Gene* 215: 471) prior to diversifying according to any of the methods described herein.

Libraries can be biased towards nucleic acids which encode proteins with desirable enzyme activities. For example, after identifying a variant from a library which exhibits a specified activity, the variant can be mutagenized using any known method for introducing DNA alterations. A library comprising the mutagenized homologues is then screened for a desired activity, which can be the same as or different from the initially specified activity. An example of such a procedure is proposed in U.S. Pat. No. 5,939,250. Desired activities can be identified by any method known in the art. For example, WO 99/10539 proposes that gene libraries can be screened by combining extracts from the gene library with components obtained from metabolically rich cells and identifying combinations which exhibit the desired activity. It has also been proposed (e.g., WO 98/58085) that clones with desired activities can be identified by inserting bioactive substrates into samples of the library, and detecting bioactive fluorescence corresponding to the product of a desired activity using a fluorescent analyzer, e.g., a flow cytometry device, a CCD, a fluorometer, or a spectrophotometer.

Libraries can also be biased towards nucleic acids which have specified characteristics, e.g., hybridization to a selected nucleic acid probe. For example, application WO 99/10539 proposes that polynucleotides encoding a desired activity (e.g., an enzymatic activity, for example: a lipase, an esterase, a protease, a glycosidase, a glycosyl transferase, a phosphatase, a kinase, an oxygenase, a peroxidase, a hydrolase, a hydratase, a nitrilase, a transaminase, an amidase or an acylase) can be identified from among genomic DNA sequences in the following manner. Single stranded DNA molecules from a population of genomic DNA are hybridized to a ligand-conjugated probe. The genomic DNA can be derived from either a cultivated or uncultivated microorganism, or from an environmental sample. Alternatively, the genomic DNA can be derived from a multicellular organism, or a tissue derived there from. Second strand synthesis can be conducted directly from the hybridization probe used in the capture, with or without prior release from the capture medium or by a wide variety of other strategies known in the art. Alternatively, the isolated single-stranded genomic DNA population can be fragmented without further cloning and used directly in, e.g., a recombination-based approach, that employs a single-stranded template, as described above.

"Non-Stochastic" methods of generating nucleic acids and polypeptides are found in WO 00/46344. These methods, including proposed non-stochastic polynucleotide reassembly and site-saturation mutagenesis methods be applied to the present invention as well. Random or semi-random mutagenesis using doped or degenerate oligonucleotides is also described in, e.g., Arkin and Youvan (1992) *Biotechnology* 10:297-300; Reidhaar-Olson et al. (1991) *Methods Enzymol.* 208:564-86; Lim and Sauer (1991) *J. Mol. Biol.* 219:359-76; Breyer and Sauer (1989) *J. Biol. Chem.* 264: 13355-60); and U.S. Pat. Nos. 5,830,650 and 5,798,208, and EP Patent 0527809 B1.

It will readily be appreciated that any of the above described techniques suitable for enriching a library prior to diversification can also be used to screen the products, or libraries of products, produced by the diversity generating methods. Any of the above described methods can be practiced recursively or in combination to alter nucleic acids, e.g., meganuclease encoding polynucleotides.

The above references provide many mutational formats, including recombination, recursive recombination, recursive mutation and combinations or recombination with other forms of mutagenesis, as well as many modifications of these formats. Regardless of the diversity generation format that is used, the nucleic acids of the present invention can be recombined (with each other, or with related (or even unrelated) sequences) to produce a diverse set of recombinant nucleic acids for use in the gene fusion constructs and modified gene fusion constructs of the present invention, including, e.g., sets of homologous nucleic acids, as well as corresponding polypeptides.

Many of the above-described methodologies for generating modified polynucleotides generate a large number of diverse variants of a parental sequence or sequences. In some embodiments, the modification technique (e.g., some form of shuffling) is used to generate a library of variants that is then screened for a modified polynucleotide or pool of modified polynucleotides encoding some desired functional attribute, e.g., increased meganuclease activity.

For convenience and high throughput it will often be desirable to screen/select for desired modified nucleic acids in a microorganism, e.g., a bacteria such as *E. coli*. On the other hand, screening in plant cells or plants can in some cases be preferable where the ultimate aim is to generate a modified nucleic acid for expression in a plant system.

In some preferred embodiments of the invention throughput is increased by screening pools of host cells expressing different modified nucleic acids, either alone or as part of a gene fusion construct. Any pools showing significant activity can be deconvoluted to identify single variants expressing the desirable activity.

In high throughput assays, it is possible to screen up to several thousand different variants in a single day. For example, each well of a microtiter plate can be used to run a separate assay, or, if concentration or incubation time effects are to be observed, every 5-10 wells can test a single variant.

In addition to fluidic approaches, it is possible, as mentioned above, simply to grow cells on media plates that select for the desired enzymatic or metabolic function. This approach offers a simple and high-throughput screening method.

A number of well known robotic systems have also been developed for solution phase chemistries useful in assay systems. These systems include automated workstations like the automated synthesis apparatus developed by Takeda Chemical Industries, LTD. (Osaka, Japan) and many robotic systems utilizing robotic arms (Zymate II, Zymark Corporation, Hopkinton, Mass.; Orca, Hewlett-Packard, Palo Alto, Calif.) which mimic the manual synthetic operations performed by a scientist. Any of the above devices are suitable for application to the present invention. The nature and implementation of modifications to these devices (if any) so that they can operate as discussed herein with reference to the integrated system will be apparent to persons skilled in the relevant art.

High throughput screening systems are commercially available (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization.

The manufacturers of such systems provide detailed protocols for the various high throughput devices. Thus, for example, Zymark Corp. provides technical bulletins describing screening systems for detecting the modulation of gene transcription, ligand binding, and the like. Microfluidic approaches to reagent manipulation have also been developed, e.g., by Caliper Technologies (Mountain View, Calif.).

Yeast and Plants

Yeast, plants, plant cells, plant parts and seeds, and grain having the meganuclease sequences disclosed herein are provided. In specific embodiments, the yeast, plants and/or plant parts have stably incorporated at least one heterologous meganuclease polypeptide disclosed herein or an active variant or fragment thereof. Thus, yeast, plants, plant cells, plant parts and seed are provided which comprise at least one heterologous meganuclease sequences of any one of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 262, 272, 273, 274, 275, 284, 285, 286, 287, 288, 289, 290, 291, 292, 293, 294, 295, 296, 297, 298, 315, 316, 317, 318, 319, 320, 330, 331, 332, 334, 335, 336, 337, 338, 339, 340, 341, 357, 358, 359, 360, 361, 362, 363, 364, 365, 366, 367, 368, 369, 370, 370, 371, 390, 391, 392, 393, 394, 395, 396, 397, 398, 399, 400, 401, 402 or 403 or any one of other variants disclosed herein, such as those in Example 3-23 or a biologically active fragment and/or variant of the meganuclease sequence. In specific embodiments, the meganuclease sequences are characterized as having meganuclease activity.

In specific embodiments, the heterologous polynucleotide in the plant or plant part is operably linked to a constitutive, tissue-preferred, or other promoter for expression in plants.

The yeast, plant cell, plant, plant part and seed can comprise any of the recognition sequence provided herein. For example, the recognition site can be selected from the group consisting of the LIG3-4 (SEQ ID NO: 2), MHP77 (SEQ ID NO: 85), MS26 (SEQ ID NO: 269), MHP14 (SEQ ID NO: 281), MP107 (SEQ ID NO: 328), ZM6.3 (SEQ ID NO: 355), ZM6.22V2 (SEQ ID NO: 388), TS21 (SEQ ID NO: 423) and/or TS14 (SEQ ID NO: 424) recognition sequences or an active variant thereof.

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

A transformed plant or transformed plant cell provided herein is one in which genetic alteration, such as transformation, has been affected as to a gene of interest, or is a plant or plant cell which is descended from a plant or cell so altered and which comprises the alteration. A "transgene" is a gene that has been introduced into the genome by a transformation procedure. Accordingly, a "transgenic plant" is a plant that contains a transgene, whether the transgene was introduced into that particular plant by transformation or by breeding; thus, descendants of an originally-transformed plant are encompassed by the definition. A "control" or "control plant" or "control plant cell" provides a reference point for measuring changes in phenotype of the subject plant or plant cell. A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e., with a construct which does not express the transgene, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the transgene; or (e) the subject plant or plant cell itself, under conditions in which the construct is not expressed.

Plant cells that have been transformed to express a meganuclease provided herein can be grown into whole plants. The regeneration, development, and cultivation of plants from single plant protoplast transformants or from various transformed explants is well known in the art. See, for example, McCormick et al. (1986) *Plant Cell Reports* 5:81-84; Weissbach and Weissbach, In: Methods for Plant Molecular Biology, (Eds.), Academic Press, Inc. San Diego, Calif., (1988). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. Two or more generations may be grown to ensure that expression of the desired phenotypic characteristic is stably maintained and inherited and then seeds harvested to ensure expression of the desired phenotypic characteristic has been achieved. In this manner, the compositions presented herein provide transformed seed (also referred to as "transgenic seed") having a polynucleotide provided herein, for example, a target site, stably incorporated into their genome.

The meganuclease sequences and active variant and fragments thereof disclosed herein may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*), and Poplar and Eucalyptus. In specific embodiments, plants of the present invention are crop plants (for example, corn, alfalfa, sunflower, *Brassica*, soybean, cotton, safflower, peanut, sorghum, wheat, millet, tobacco, etc.). In other embodiments, corn and soybean plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

Non-limiting examples of compositions and methods disclosed herein are as follows:
1. An isolated or recombinant polynucleotide comprising a nucleotide sequence encoding a meganuclease polypeptide, said polypeptide comprising:
   a) an amino acid sequence having at least one amino acid modification at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; or,
   b) an amino acid sequence having at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 or 44 of any of the amino acid modification of (a);
2. The isolated or recombinant polynucleotide of embodiment 1, wherein said nucleotide sequence encodes a meganuclease polypeptide having at least 80%, 81, %, 82%, 83%, 84%, 85%, 86%, 87%, 88%, 89%, 90%, 91%, 92%, 93%, 94%, 95%, 96%, 97%, 98%, 99% sequence identity to SEQ ID NO: 1.
3. The isolated or recombinant polynucleotide of embodiment 1, wherein said at least one amino acid modification comprises;
   a) an aspartic acid (D) at a position corresponding to amino acid position 2 in SEQ ID NO: 1;
   b) a histidine (H) at a position corresponding to amino acid position 12 in SEQ ID NO: 1;
   c) an isoleucine (I) at a position corresponding to amino acid position 16 in SEQ ID NO: 1;
   d) a cysteine (C) at a position corresponding to amino acid position 22 in SEQ ID NO: 1;
   e) a leucine (L) at a position corresponding to amino acid position 23 in SEQ ID NO: 1;
   f) an arginine (R) at a position corresponding to amino acid position 31 in SEQ ID NO: 1;
   g) an asparagine (N) at a position corresponding to amino acid position 36 in SEQ ID NO: 1;
   h) a leucine (L) at a position corresponding to amino acid position 43 in SEQ ID NO: 1;
   i) an arginine (R) or lysine (K) at a position corresponding to amino acid position 50 in SEQ ID NO: 1;
   j) a leucine (L) at a position corresponding to amino acid position 56 in SEQ ID NO: 1;
   k) an isoleucine (I) at a position corresponding to amino acid position 58 in SEQ ID NO: 1;
   l) a histidine (H) or alanine (A) at a position corresponding to amino acid position 59 in SEQ ID NO: 1;
   m) a valine (V) at a position corresponding to amino acid position 62 in SEQ ID NO: 1;
   n) a lysine (K) at a position corresponding to amino acid position 71 in SEQ ID NO: 1;
   o) a threonine (T) at a position corresponding to amino acid position 72 in SEQ ID NO: 1;
   p) an alanine (A) at a position corresponding to amino acid position 73 in SEQ ID NO: 1;
   q) an arginine (R) at a position corresponding to amino acid position 80 in SEQ ID NO: 1;
   r) a lysine (K) at a position corresponding to amino acid position 81 in SEQ ID NO: 1;
   s) an arginine (R) at a position corresponding to amino acid position 82 in SEQ ID NO: 1;
   t) an aspartic acid (D) at a position corresponding to amino acid position 86 in SEQ ID NO: 1;
   u) an isoleucine (I) at a position corresponding to amino acid position 91 in SEQ ID NO: 1;
   v) an isoleucine (I) at a position corresponding to amino acid position 95 in SEQ ID NO: 1;
   w) an arginine (R) at a position corresponding to amino acid position 98 in SEQ ID NO: 1;
   x) a valine (V) at a position corresponding to amino acid position 103 in SEQ ID NO: 1;
   y) a serine (S) at a position corresponding to amino acid position 113 in SEQ ID NO: 1;
   z) a proline (P) at a position corresponding to amino acid position 114 in SEQ ID NO: 1;
   aa) an arginine (R) at a position corresponding to amino acid position 116 in SEQ ID NO: 1;
   bb) a glycine (G) at a position corresponding to amino acid position 117 in SEQ ID NO: 1;
   cc) a threonine (T) at a position corresponding to amino acid position 118 in SEQ ID NO: 1;
   dd) a an glycine (G) at a position corresponding to amino acid position 121 in SEQ ID NO: 1;
   ee) an arginine (R) at a position corresponding to amino acid position 124 in SEQ ID NO: 1;
   ff) a cysteine (C) at a position corresponding to amino acid position 128 in SEQ ID NO: 1;
   gg) an alanine (A) at a position corresponding to amino acid position 129 in SEQ ID NO: 1;
   hh) an arginine (R) at a position corresponding to amino acid position 131 in SEQ ID NO: 1;
   ii) a serine (S) at a position corresponding to amino acid position 147 in SEQ ID NO: 1;
   jj) an alanine (A) at a position corresponding to amino acid position 151 in SEQ ID NO: 1;
   kk) a leucine (L) or a methionine (M) at a position corresponding to amino acid position 153 in SEQ ID NO: 1;
   ll) a tryptophan (W) at a position corresponding to amino acid position 159 in SEQ ID NO: 1;
   mm) a glutamic acid (E) at a position corresponding to amino acid position 160 in SEQ ID NO: 1;
   nn) a valine (V) at a position corresponding to amino acid position 161 in SEQ ID NO: 1;

oo) a tyrosine (Y) at a position corresponding to amino acid position 162 in SEQ ID NO: 1;
pp) an arginine (R) at a position corresponding to amino acid position 163 in SEQ ID NO: 1;
qq) a histidine (H) at a position corresponding to amino acid position 164 in SEQ ID NO: 1;
rr) a leucine (L) at a position corresponding to amino acid position 165 in SEQ ID NO: 1;
ss) an arginine (R) at a position corresponding to amino acid position 166 in SEQ ID NO: 1;
tt) a histidine (H) at a position corresponding to amino acid position 167 in SEQ ID NO: 1;
uu) a proline (P) at a position corresponding to amino acid position 168 in SEQ ID NO: 1;
vv) an alanine (A) at a position corresponding to amino acid position 169 in SEQ ID NO: 1;
ww) a proline (P) at a position corresponding to amino acid position 170 in SEQ ID NO: 1;
xx) a histidine (H) at a position corresponding to amino acid position 171 in SEQ ID NO: 1;
yy) a proline (P) at a position corresponding to amino acid position 172 in SEQ ID NO: 1;
zz) an arginine (R) at a position corresponding to amino acid position 173 in SEQ ID NO: 1;
aaa) a leucine (L) at a position corresponding to amino acid position 174 in SEQ ID NO: 1;
bbb) a proline (P) at a position corresponding to amino acid position 175 in SEQ ID NO: 1;
ccc) a glutamine (Q) at a position corresponding to amino acid position 176 in SEQ ID NO: 1;
ddd) an alanine (A) at a position corresponding to amino acid position 177 in SEQ ID NO: 1;
eee) an arginine (R) at a position corresponding to amino acid position 178 in SEQ ID NO: 1;
fff) a valine (V) at a position corresponding to amino acid position 179 in SEQ ID NO: 1;
ggg) a glutamine (Q) at a position corresponding to amino acid position 180 in SEQ ID NO: 1;
hhh) a valine (V) at a position corresponding to amino acid position 182 in SEQ ID NO: 1;
iii) a proline (P) at a position corresponding to amino acid position 183 in SEQ ID NO: 1;
jjj) a lysine (K) at a position corresponding to amino acid position 184 in SEQ ID NO: 1;
kkk) a threonine (T) or a histidine (H) at a position corresponding to amino acid position 185 in SEQ ID NO: 1;
lll) a serine (S) at a position corresponding to amino acid position 186 in SEQ ID NO: 1;
mmm) a glutamic acid (E) at a position corresponding to amino acid position 187 in SEQ ID NO: 1;
nnn) a leucine (L) at a position corresponding to amino acid position 188 in SEQ ID NO: 1;
ooo) a glutamic acid (E) at a position corresponding to amino acid position 189 in SEQ ID NO: 1;
ppp) a glutamine (Q) at a position corresponding to amino acid position 190 in SEQ ID NO: 1;
qqq) a leucine (L) at a position corresponding to amino acid position 191 in SEQ ID NO: 1;
rrr) a proline (P) at a position corresponding to amino acid position 194 in SEQ ID NO: 1;
sss) a lysine (K) at a position corresponding to amino acid position 195 in SEQ ID NO: 1;
ttt) a serine (S) at a position corresponding to amino acid position 196 in SEQ ID NO: 1;
uuu) a phenylalanine (F) at a position corresponding to amino acid position 197 in SEQ ID NO: 1;
vvv) an isoleucine (I) at a position corresponding to amino acid position 200 in SEQ ID NO: 1;
www) a valine (V) at a position corresponding to amino acid position 203 in SEQ ID NO: 1;
xxx) a leucine (L) at a position corresponding to amino acid position 204 in SEQ ID NO: 1;
yyy) a cysteine (C) at a position corresponding to amino acid position 209 in SEQ ID NO: 1;
zzz) a leucine (L) at a position corresponding to amino acid position 222 in SEQ ID NO: 1;
aaaa) an isoleucine (I) at a position corresponding to amino acid position 232 in SEQ ID NO: 1;
bbbb) a serine (S) at a position corresponding to amino acid position 236 in SEQ ID NO: 1;
cccc) a leucine (L) or an arginine (R) at a position corresponding to amino acid position 237 in SEQ ID NO: 1;
dddd) a histidine (H) at a position corresponding to amino acid position 246 in SEQ ID NO: 1;
eeee) an isoleucine (I) at a position corresponding to amino acid position 254 in SEQ ID NO: 1;
ffff) a serine (S) at a position corresponding to amino acid position 258 in SEQ ID NO: 1;
gggg) an arginine (R) at a position corresponding to amino acid position 267 in SEQ ID NO: 1;
hhhh) an isoleucine (I) at a position corresponding to amino acid position 278 in SEQ ID NO: 1;
iiii) a tyrosine (Y) at a position corresponding to amino acid position 281 in SEQ ID NO: 1;
jjjj) a phenylalanine (F) at a position corresponding to amino acid position 282 in SEQ ID NO: 1;
kkkk) a threonine (T) at a position corresponding to amino acid position 289 in SEQ ID NO: 1;
llll) a glycine (G) at a position corresponding to amino acid position 308 in SEQ ID NO: 1;
mmmm) an arginine (R) at a position corresponding to amino acid position 311 in SEQ ID NO: 1;
nnnn) an alanine (A) at a position corresponding to amino acid position 312 in SEQ ID NO: 1;
oooo) an alanine (A) at a position corresponding to amino acid position 316 in SEQ ID NO: 1;
pppp) an arginine (R) at a position corresponding to amino acid position 318 in SEQ ID NO: 1
qqqq) an alanine (A) at a position corresponding to amino acid position 334 in SEQ ID NO: 1;
rrrr) a phenylalanine (F) at a position corresponding to amino acid position 339 in SEQ ID NO: 1;
ssss) a glycine (G) or a leucine (L) at a position corresponding to amino acid position 340 in SEQ ID NO: 1;
tttt) a serine (S) at a position corresponding to amino acid position 342 in SEQ ID NO: 1;
uuuu) an asparagine (N) at a position corresponding to amino acid position 345 in SEQ ID NO: 1;
vvvv) an asparagine (N) at a position corresponding to amino acid position 346 in SEQ ID NO: 1;
wwww) an asparagine (N) at a position corresponding to amino acid position 348 in SEQ ID NO: 1; or,
xxxx) any combination of a) to wwww).

4. The isolated or recombinant polynucleotide of embodiment 1, wherein said nucleotide sequence encodes a meganuclease polypeptide, wherein said polypeptide further comprises:
a) an aspartic acid (D) at a position corresponding to amino acid position 2 in SEQ ID NO: 1;
b) a histidine (H) at a position corresponding to amino acid position 12 in SEQ ID NO: 1;

c) an isoleucine (I) at a position corresponding to amino acid position 16 in SEQ ID NO: 1;
d) a serine (S) or an alanine (A) at a position corresponding to amino acid position 19 in SEQ ID NO: 1;
e) a cysteine (C) at a position corresponding to amino acid position 22 in SEQ ID NO: 1;
f) a leucine (L) at a position corresponding to amino acid position 23 in SEQ ID NO: 1;
g) a methionine (M) at a position corresponding to amino acid position 24 in SEQ ID NO: 1;
h) an arginine (R) or an alanine (A) at a position corresponding to amino acid position 28 in SEQ ID NO: 1;
i) an arginine (R), alanine (A), glutamine (Q), cysteine (C), glycine (G), serine (S), threonine (T), leucine (L), glutamic acid (E), or a proline (P) at a position corresponding to amino acid position 30 in SEQ ID NO: 1;
j) an arginine (R) at a position corresponding to amino acid position 31 in SEQ ID NO: 1;
k) an arginine (R), alanine (A), lysine (K) glutamine (Q), glycine (G) or a leucine (L) at a position corresponding to amino acid position 32 in SEQ ID NO: 1;
l) an asparagine (N) at a position corresponding to amino acid position 36 in SEQ ID NO: 1;
m) a leucine (L) at a position corresponding to amino acid position 43 in SEQ ID NO: 1;
n) an arginine (R) or lysine (K) at a position corresponding to amino acid position 50 in SEQ ID NO: 1;
o) an isoleucine (I) or a leucine (L) at a position corresponding to amino acid position 54 in SEQ ID NO: 1;
p) a leucine (L) at a position corresponding to amino acid position 56 in SEQ ID NO: 1;
q) a glutamic acid (E) at a position corresponding to amino acid position 57 in SEQ ID NO: 1;
r) an isoleucine (I) at a position corresponding to amino acid position 58 in SEQ ID NO: 1;
s) a histidine (H) or alanine (A) at a position corresponding to amino acid position 59 in SEQ ID NO: 1;
t) a valine (V) at a position corresponding to amino acid position 62 in SEQ ID NO: 1;
u) a lysine (K) at a position corresponding to amino acid position 71 in SEQ ID NO: 1;
v) a threonine (T) at a position corresponding to amino acid position 72 in SEQ ID NO: 1;
w) an alanine (A) at a position corresponding to amino acid position 73 in SEQ ID NO: 1;
x) a glycine (G) at a position corresponding to amino acid position 79 in SEQ ID NO: 1;
y) an arginine (R) at a position corresponding to amino acid position 80 in SEQ ID NO: 1;
z) a lysine (K) at a position corresponding to amino acid position 81 in SEQ ID NO: 1;
aa) an arginine (R) at a position corresponding to amino acid position 82 in SEQ ID NO: 1;
bb) an aspartic acid (D) at a position corresponding to amino acid position 86 in SEQ ID NO: 1;
cc) a leucine (L) at a position corresponding to amino acid position 87 in SEQ ID NO: 1;
dd) an isoleucine (I) at a position corresponding to amino acid position 91 in SEQ ID NO: 1;
ee) an isoleucine (I) at a position corresponding to amino acid position 95 in SEQ ID NO: 1;
ff) an arginine (R) at a position corresponding to amino acid position 98 in SEQ ID NO: 1;
gg) a valine (V) at a position corresponding to amino acid position 103 in SEQ ID NO: 1;
hh) an alanine (A) at a position corresponding to amino acid position 105 in SEQ ID NO: 1;
ii) an arginine (R) at a position corresponding to amino acid position 111 in SEQ ID NO: 1;
jj) a serine (S) at a position corresponding to amino acid position 113 in SEQ ID NO: 1;
kk) a proline (P) at a position corresponding to amino acid position 114 in SEQ ID NO: 1;
ll) an arginine (R) at a position corresponding to amino acid position 116 in SEQ ID NO: 1;
mm) a an glycine (G) at a position corresponding to amino acid position 117 in SEQ ID NO: 1;
nn) a threonine (T) at a position corresponding to amino acid position 118 in SEQ ID NO: 1;
oo) a an glycine (G) at a position corresponding to amino acid position 121 in SEQ ID NO: 1;
pp) an arginine (R) at a position corresponding to amino acid position 124 in SEQ ID NO: 1;
qq) a cysteine (C) at a position corresponding to amino acid position 128 in SEQ ID NO: 1;
rr) an alanine (A) at a position corresponding to amino acid position 129 in SEQ ID NO: 1;
ss) an arginine (R) at a position corresponding to amino acid position 131 in SEQ ID NO: 1;
tt) a valine (V) at a position corresponding to amino acid position 132 in SEQ ID NO: 1;
uu) a serine (S) at a position corresponding to amino acid position 147 in SEQ ID NO: 1;
vv) an alanine (A) at a position corresponding to amino acid position 151 in SEQ ID NO: 1;
ww) a leucine (L) or a methionine (M) at a position corresponding to amino acid position 153 in SEQ ID NO: 1;
xx) a tryptophan (W) at a position corresponding to amino acid position 159 in SEQ ID NO: 1;
yy) a glutamic acid (E) at a position corresponding to amino acid position 160 in SEQ ID NO: 1;
zz) a valine (V) at a position corresponding to amino acid position 161 in SEQ ID NO: 1;
aaa) a tyrosine (Y) at a position corresponding to amino acid position 162 in SEQ ID NO: 1; bbb) an arginine (R) at a position corresponding to amino acid position 163 in SEQ ID NO: 1;
ccc) a histidine (H) at a position corresponding to amino acid position 164 in SEQ ID NO: 1;
ddd) a leucine (L) at a position corresponding to amino acid position 165 in SEQ ID NO: 1;
eee) an arginine (R) at a position corresponding to amino acid position 166 in SEQ ID NO: 1;
fff) a histidine (H) at a position corresponding to amino acid position 167 in SEQ ID NO: 1;
ggg) a proline (P) at a position corresponding to amino acid position 168 in SEQ ID NO: 1;
hhh) an alanine (A) at a position corresponding to amino acid position 169 in SEQ ID NO: 1;
iii) a proline (P) at a position corresponding to amino acid position 170 in SEQ ID NO: 1;
jjj) a histidine (H) at a position corresponding to amino acid position 171 in SEQ ID NO: 1;
kkk) a proline (P) at a position corresponding to amino acid position 172 in SEQ ID NO: 1;
lll) an arginine (R) at a position corresponding to amino acid position 173 in SEQ ID NO: 1;
mmm) a leucine (L) at a position corresponding to amino acid position 174 in SEQ ID NO: 1;
nnn) a proline (P) at a position corresponding to amino acid position 175 in SEQ ID NO: 1;
ooo) a glutamine (Q) at a position corresponding to amino acid position 176 in SEQ ID NO: 1;

ppp) an alanine (A) at a position corresponding to amino acid position 177 in SEQ ID NO: 1;
qqq) an arginine (R) at a position corresponding to amino acid position 178 in SEQ ID NO: 1;
rrr) a valine (V) at a position corresponding to amino acid position 179 in SEQ ID NO: 1;
sss) a glutamine (Q) at a position corresponding to amino acid position 180 in SEQ ID NO: 1;
ttt) a valine (V) at a position corresponding to amino acid position 182 in SEQ ID NO: 1;
uuu) a proline (P) at a position corresponding to amino acid position 183 in SEQ ID NO: 1;
vvv) a lysine (K) at a position corresponding to amino acid position 184 in SEQ ID NO: 1;
www) a threonine (T) or a histidine (H) at a position corresponding to amino acid position 185 in SEQ ID NO: 1;
xxx) a serine (S) at a position corresponding to amino acid position 186 in SEQ ID NO: 1;
yyy) a glutamic acid (E) at a position corresponding to amino acid position 187 in SEQ ID NO: 1;
zzz) a leucine (L) at a position corresponding to amino acid position 188 in SEQ ID NO: 1;
aaaa) a glutamic acid (E) at a position corresponding to amino acid position 189 in SEQ ID NO: 1;
bbbb) a glutamine (Q) at a position corresponding to amino acid position 190 in SEQ ID NO: 1;
cccc) a leucine (L) at a position corresponding to amino acid position 191 in SEQ ID NO: 1;
dddd) an amino acid deletion at a position corresponding to amino acid position 192 in SEQ ID NO: 1;
eeee) a proline (P) at a position corresponding to amino acid position 194 in SEQ ID NO: 1;
ffff) a lysine (K) at a position corresponding to amino acid position 195 in SEQ ID NO: 1;
gggg) a serine (S) at a position corresponding to amino acid position 196 in SEQ ID NO: 1;
hhhh) a phenylalanine (F) at a position corresponding to amino acid position 197 in SEQ ID NO: 1;
iiii) an isoleucine (I) at a position corresponding to amino acid position 200 in SEQ ID NO: 1;
jjjj) a valine (V) at a position corresponding to amino acid position 203 in SEQ ID NO: 1;
kkkk) a leucine (L) at a position corresponding to amino acid position 204 in SEQ ID NO: 1;
llll) an alanine (A) or a serine (S) at a position corresponding to amino acid position 206 in SEQ ID NO: 1;
mmmm) a cysteine (C) at a position corresponding to amino acid position 209 in SEQ ID NO: 1;
nnnn) a leucine (L) at a position corresponding to amino acid position 222 in SEQ ID NO: 1;
oooo) a methionine (M) at a position corresponding to amino acid position 211 in SEQ ID NO: 1;
pppp) an isoleucine (I) at a position corresponding to amino acid position 232 in SEQ ID NO: 1;
qqqq) a serine (S) at a position corresponding to amino acid position 236 in SEQ ID NO: 1;
rrrr) a leucine (L) or an arginine (R) at a position corresponding to amino acid position 237 in SEQ ID NO: 1;
ssss) an isoleucine (I) or a leucine (L) at a position corresponding to amino acid position 241 in SEQ ID NO: 1;
tttt) a glutamic acid (E) at a position corresponding to amino acid position 244 in SEQ ID NO: 1;
uuuu) a histidine (H) at a position corresponding to amino acid position 246 in SEQ ID NO: 1;
vvvv) an aspartic acid (D) or histidine (H) at a position corresponding to amino acid position 253 in SEQ ID NO: 1;
wwww) an isoleucine (I) at a position corresponding to amino acid position 254 in SEQ ID NO: 1;
xxxx) a serine (S) at a position corresponding to amino acid position 258 in SEQ ID NO: 1;
yyyy) an arginine (R) at a position corresponding to amino acid position 267 in SEQ ID NO: 1;
zzzz) an isoleucine (I) at a position corresponding to amino acid position 278 in SEQ ID NO: 1;
aaaaa) a tyrosine (Y) at a position corresponding to amino acid position 281 in SEQ ID NO: 1;
bbbbb) a phenylalanine (F) at a position corresponding to amino acid position 282 in SEQ ID NO: 1;
ccccc) a threonine (T) at a position corresponding to amino acid position 289 in SEQ ID NO: 1;
ddddd) an alanine (A) at a position corresponding to amino acid position 292 in SEQ ID NO: 1;
eeeee) a glycine (G) at a position corresponding to amino acid position 308 in SEQ ID NO: 1;
fffff) an arginine (R) at a position corresponding to amino acid position 311 in SEQ ID NO: 1;
ggggg) an alanine (A) at a position corresponding to amino acid position 312 in SEQ ID NO: 1;
hhhhh) an alanine (A) at a position corresponding to amino acid position 316 in SEQ ID NO: 1;
iiiii) an arginine (R) at a position corresponding to amino acid position 318 in SEQ ID NO: 1
jjjjj) a valine (V) at a position corresponding to amino acid position 319 in SEQ ID NO: 1;
kkkkk) an alanine (A) at a position corresponding to amino acid position 334 in SEQ ID NO: 1;
lllll) a phenylalanine (F) at a position corresponding to amino acid position 339 in SEQ ID NO: 1;
mmmmm) a glycine (G) or a leucine (L) at a position corresponding to amino acid position 340 in SEQ ID NO: 1;
nnnnn) a serine (S) at a position corresponding to amino acid position 342 in SEQ ID NO: 1;
ooooo) an asparagine (N) at a position corresponding to amino acid position 345 in SEQ ID NO: 1;
ppppp) an asparagine (N) at a position corresponding to amino acid position 346 in SEQ ID NO: 1; or,
qqqqq) an asparagine (N) at a position corresponding to amino acid position 348 in SEQ ID NO: 1; or,
rrrrr) any combination of a) to qqqqq).

5. The isolated or recombinant polynucleotide of embodiment 1, wherein said nucleotide sequence encodes a meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402, 403, 430, 431, 432 and 433.

6. The isolated or recombinant polynucleotide of embodiment 1, wherein said nucleotide sequence encodes a meganuclease polypeptide, wherein the polypeptide is capable of recognizing and cleaving a meganuclease recognition sequence selected from the group consisting of SEQ ID NO: 2 (LIG3-4), SEQ ID NO: 85 (MHP77), SEQ ID NO:269 (MS26), SEQ ID NO:281 (MHP14), SEQ ID NO: 331(MP107), SEQ ID NO:358 (ZM6.3), SEQ ID NO:390 (ZM6.22v2), SEQ ID NO:423 or SEQ ID NO:424.

7. The isolated or recombinant polynucleotide of embodiment 1, wherein said nucleotide sequence encodes a meganuclease polypeptide, wherein said polypeptide has an increased meganuclease activity when compared to a control meganuclease that lacks said amino acid modification.

8. The isolated or recombinant polynucleotide of embodiment 7, wherein said control meganuclease is selected from the group of SEQ ID NO:1 (LIG3-4), SEQ ID NO: 86 (MHP77), SEQ ID NO: 250 (MHP77.3), SEQ ID NO:270 (MS26+), SEQ ID NO:271, SEQ ID NO:282 (MHP14), SEQ ID NO:283 (MHP14+), SEQ ID NO: 329 (MP107), SEQ ID NO:356 (ZM6.3), SEQ ID NO:389 (ZM6.22v2), SEQ ID NO:429 or SEQ ID NO:435.

9. The isolated or recombinant polynucleotide of embodiment 7, wherein the increased meganuclease activity is evidenced by:
   a) a higher yeast assay score when compared to the control meganuclease that lacks said amino acid modification; or,
   b) a higher target site mutation rate when compared to the control meganuclease that lacks said amino acid modification; or,
   c) a higher in-vitro cutting when compared to the control meganuclease that lacks said amino acid modification; or,
   d) any combination of (a), (b) and (c).

10. The isolated or recombinant polynucleotide of embodiment 1, further comprising a nucleotide sequence encoding a N-terminal nuclear transit peptide.

11. The isolated or recombinant polynucleotide of embodiment 1, further comprising a nucleotide sequence encoding a C-terminal histidine tag.

12. The isolated or recombinant polynucleotide of embodiment 7, wherein the increased meganuclease activity is determined at 16° C., 24° C., 28° C., 30° C. or 37° C.

13. A recombinant DNA construct, comprising the isolated or recombinant polynucleotide of embodiment 1.

14. The recombinant DNA construct of embodiment 13, further comprising a promoter operably linked to said polynucleotide.

15. The recombinant DNA construct of embodiment 14, wherein said promoter is heterologous with respect to said polynucleotide or said promoter is homologous with respect to said polynucleotide.

16. A cell comprising at least one polynucleotide of embodiment 1 or the recombinant DNA construct of embodiment 13, wherein said polynucleotide is heterologous to the cell.

17. The cell of embodiment 16, wherein said cell is a yeast cell.

18. The cell of embodiment 16, wherein said cell is a plant cell.

19. The cell of embodiment 16, wherein said polynucleotide or said recombinant DNA construct is stably incorporated into the genome of said plant cell.

20. The cell of embodiment 16, wherein said polynucleotide or said recombinant DNA construct is stably incorporated into the chloroplast genome of said plant cell.

21. The cell of embodiment 18, wherein said plant cell is from a monocot.

22. The cell of embodiment 21 wherein said monocot is maize, wheat, rice, barley, sugarcane, sorghum, or rye.

23. The cell of embodiment 18, wherein said plant cell is from a dicot.

24. The cell of embodiment 23, wherein the dicot is soybean, Brassica, sunflower, cotton, or alfalfa.

25. A plant comprising a plant cell of embodiment 18.

26. A plant explant comprising a plant cell of embodiment 18.

27. The plant, the explant or the plant cell of embodiment 26, wherein said plant, explant or plant cell exhibits an increased meganuclease activity when compared to a plant, explant or plant cell of the same species, strain or cultivar that does not comprise at least one polynucleotide of embodiments 1.

28. A transgenic seed produced by the plant of embodiment 25.

29. An isolated polypeptide having meganuclease activity, said polypeptide comprising:
   a) an amino acid sequence having at least one amino acid modification at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; or,
   b) an amino acid sequence having at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 or 44 of any of the amino acid modification of (a);

30. The isolated polypeptide of embodiment 29, wherein said polypeptide has at least 80% sequence identity to SEQ ID NO: 1.

31. The isolated polypeptide of embodiment 29, wherein said at least one amino acid modification comprises:
   a) an aspartic acid (D) at a position corresponding to amino acid position 2 in SEQ ID NO: 1;
   b) a histidine (H) at a position corresponding to amino acid position 12 in SEQ ID NO: 1;
   c) an isoleucine (I) at a position corresponding to amino acid position 16 in SEQ ID NO: 1;
   d) a cysteine (C) at a position corresponding to amino acid position 22 in SEQ ID NO: 1;
   e) a leucine (L) at a position corresponding to amino acid position 23 in SEQ ID NO: 1;
   f) an arginine (R) at a position corresponding to amino acid position 31 in SEQ ID NO: 1;
   g) an asparagine (N) at a position corresponding to amino acid position 36 in SEQ ID NO: 1;
   h) a leucine (L) at a position corresponding to amino acid position 43 in SEQ ID NO: 1;
   i) an arginine (R) or lysine (K) at a position corresponding to amino acid position 50 in SEQ ID NO: 1;
   j) a leucine (L) at a position corresponding to amino acid position 56 in SEQ ID NO: 1;

k) an isoleucine (I) at a position corresponding to amino acid position 58 in SEQ ID NO: 1;
l) a histidine (H) or alanine (A) at a position corresponding to amino acid position 59 in SEQ ID NO: 1;
m) a valine (V) at a position corresponding to amino acid position 62 in SEQ ID NO: 1;
n) a lysine (K) at a position corresponding to amino acid position 71 in SEQ ID NO: 1;
o) a threonine (T) at a position corresponding to amino acid position 72 in SEQ ID NO: 1;
p) an alanine (A) at a position corresponding to amino acid position 73 in SEQ ID NO: 1;
q) an arginine (R) at a position corresponding to amino acid position 80 in SEQ ID NO: 1;
r) a lysine (K) at a position corresponding to amino acid position 81 in SEQ ID NO: 1;
s) an arginine (R) at a position corresponding to amino acid position 82 in SEQ ID NO: 1;
t) an aspartic acid (D) at a position corresponding to amino acid position 86 in SEQ ID NO: 1;
u) an isoleucine (I) at a position corresponding to amino acid position 91 in SEQ ID NO: 1;
v) an isoleucine (I) at a position corresponding to amino acid position 95 in SEQ ID NO: 1;
w) an arginine (R) at a position corresponding to amino acid position 98 in SEQ ID NO: 1;
x) a valine (V) at a position corresponding to amino acid position 103 in SEQ ID NO: 1;
y) a serine (S) at a position corresponding to amino acid position 113 in SEQ ID NO: 1;
z) a proline (P) at a position corresponding to amino acid position 114 in SEQ ID NO: 1;
aa) an arginine (R) at a position corresponding to amino acid position 116 in SEQ ID NO: 1;
bb) a glycine (G) at a position corresponding to amino acid position 117 in SEQ ID NO: 1;
cc) a threonine (T) at a position corresponding to amino acid position 118 in SEQ ID NO: 1;
dd) a an glycine (G) at a position corresponding to amino acid position 121 in SEQ ID NO: 1;
ee) an arginine (R) at a position corresponding to amino acid position 124 in SEQ ID NO: 1;
ff) a cysteine (C) at a position corresponding to amino acid position 128 in SEQ ID NO: 1;
gg) an alanine (A) at a position corresponding to amino acid position 129 in SEQ ID NO: 1;
hh) an arginine (R) at a position corresponding to amino acid position 131 in SEQ ID NO: 1;
ii) a serine (S) at a position corresponding to amino acid position 147 in SEQ ID NO: 1;
jj) an alanine (A) at a position corresponding to amino acid position 151 in SEQ ID NO: 1;
kk) a leucine (L) or a methionine (M) at a position corresponding to amino acid position 153 in SEQ ID NO: 1;
ll) a tryptophan (W) at a position corresponding to amino acid position 159 in SEQ ID NO: 1;
mm) a glutamic acid (E) at a position corresponding to amino acid position 160 in SEQ ID NO: 1;
nn) a valine (V) at a position corresponding to amino acid position 161 in SEQ ID NO: 1;
oo) a tyrosine (Y) at a position corresponding to amino acid position 162 in SEQ ID NO: 1;
pp) an arginine (R) at a position corresponding to amino acid position 163 in SEQ ID NO: 1;
qq) a histidine (H) at a position corresponding to amino acid position 164 in SEQ ID NO: 1;
rr) a leucine (L) at a position corresponding to amino acid position 165 in SEQ ID NO: 1;
ss) an arginine (R) at a position corresponding to amino acid position 166 in SEQ ID NO: 1;
tt) a histidine (H) at a position corresponding to amino acid position 167 in SEQ ID NO: 1;
uu) a proline (P) at a position corresponding to amino acid position 168 in SEQ ID NO: 1;
vv) an alanine (A) at a position corresponding to amino acid position 169 in SEQ ID NO: 1;
ww) a proline (P) at a position corresponding to amino acid position 170 in SEQ ID NO: 1;
xx) a histidine (H) at a position corresponding to amino acid position 171 in SEQ ID NO: 1;
yy) a proline (P) at a position corresponding to amino acid position 172 in SEQ ID NO: 1;
zz) an arginine (R) at a position corresponding to amino acid position 173 in SEQ ID NO: 1;
aaa) a leucine (L) at a position corresponding to amino acid position 174 in SEQ ID NO: 1;
bbb) a proline (P) at a position corresponding to amino acid position 175 in SEQ ID NO: 1;
ccc) a glutamine (Q) at a position corresponding to amino acid position 176 in SEQ ID NO: 1;
ddd) an alanine (A) at a position corresponding to amino acid position 177 in SEQ ID NO: 1;
eee) an arginine (R) at a position corresponding to amino acid position 178 in SEQ ID NO: 1;
fff) a valine (V) at a position corresponding to amino acid position 179 in SEQ ID NO: 1;
ggg) a glutamine (Q) at a position corresponding to amino acid position 180 in SEQ ID NO: 1;
hhh) a valine (V) at a position corresponding to amino acid position 182 in SEQ ID NO: 1;
iii) a proline (P) at a position corresponding to amino acid position 183 in SEQ ID NO: 1;
jjj) a lysine (K) at a position corresponding to amino acid position 184 in SEQ ID NO: 1;
kkk) a threonine (T) or a histidine (H) at a position corresponding to amino acid position 185 in SEQ ID NO: 1;
lll) a serine (S) at a position corresponding to amino acid position 186 in SEQ ID NO: 1; mmm) a glutamic acid (E) at a position corresponding to amino acid position 187 in SEQ ID NO: 1;
nnn) a leucine (L) at a position corresponding to amino acid position 188 in SEQ ID NO: 1;
ooo) a glutamic acid (E) at a position corresponding to amino acid position 189 in SEQ ID NO: 1;
ppp) a glutamine (Q) at a position corresponding to amino acid position 190 in SEQ ID NO: 1;
qqq) a leucine (L) at a position corresponding to amino acid position 191 in SEQ ID NO: 1;
rrr) a proline (P) at a position corresponding to amino acid position 194 in SEQ ID NO: 1;
sss) a lysine (K) at a position corresponding to amino acid position 195 in SEQ ID NO: 1;
ttt) a serine (S) at a position corresponding to amino acid position 196 in SEQ ID NO: 1;
uuu) a phenylalanine (F) at a position corresponding to amino acid position 197 in SEQ ID NO: 1;
vvv) an isoleucine (I) at a position corresponding to amino acid position 200 in SEQ ID NO: 1;
www) a valine (V) at a position corresponding to amino acid position 203 in SEQ ID NO: 1;
xxx) a leucine (L) at a position corresponding to amino acid position 204 in SEQ ID NO: 1;

yyy) a cysteine (C) at a position corresponding to amino acid position 209 in SEQ ID NO: 1;
zzz) a leucine (L) at a position corresponding to amino acid position 222 in SEQ ID NO: 1;
aaaa) an isoleucine (I) at a position corresponding to amino acid position 232 in SEQ ID NO: 1;
bbbb) a serine (S) at a position corresponding to amino acid position 236 in SEQ ID NO: 1;
cccc) a leucine (L) or an arginine (R) at a position corresponding to amino acid position 237 in SEQ ID NO: 1;
dddd) a histidine (H) at a position corresponding to amino acid position 246 in SEQ ID NO: 1;
eeee) an isoleucine (I) at a position corresponding to amino acid position 254 in SEQ ID NO: 1;
ffff) a serine (S) at a position corresponding to amino acid position 258 in SEQ ID NO: 1;
gggg) an arginine (R) at a position corresponding to amino acid position 267 in SEQ ID NO: 1;
hhhh) an isoleucine (I) at a position corresponding to amino acid position 278 in SEQ ID NO: 1;
iiii) a tyrosine (Y) at a position corresponding to amino acid position 281 in SEQ ID NO: 1;
jjjj) a phenylalanine (F) at a position corresponding to amino acid position 282 in SEQ ID NO: 1;
kkkk) a threonine (T) at a position corresponding to amino acid position 289 in SEQ ID NO: 1;
llll) a glycine (G) at a position corresponding to amino acid position 308 in SEQ ID NO: 1;
mmmm) an arginine (R) at a position corresponding to amino acid position 311 in SEQ ID NO: 1;
nnnn) an alanine (A) at a position corresponding to amino acid position 312 in SEQ ID NO: 1;
oooo) an alanine (A) at a position corresponding to amino acid position 316 in SEQ ID NO: 1;
pppp) an arginine (R) at a position corresponding to amino acid position 318 in SEQ ID NO: 1
qqqq) an alanine (A) at a position corresponding to amino acid position 334 in SEQ ID NO: 1;
rrrr) a phenylalanine (F) at a position corresponding to amino acid position 339 in SEQ ID NO: 1;
ssss) a glycine (G) or a leucine (L) at a position corresponding to amino acid position 340 in SEQ ID NO: 1;
tttt) a serine (S) at a position corresponding to amino acid position 342 in SEQ ID NO: 1;
uuuu) an asparagine (N) at a position corresponding to amino acid position 345 in SEQ ID NO: 1;
vvvv) an asparagine (N) at a position corresponding to amino acid position 346 in SEQ ID NO: 1;
wwww) an asparagine (N) at a position corresponding to amino acid position 348 in SEQ ID NO: 1; or,
xxxx) any combination of a) to wwww).

32. The isolated polypeptide of embodiment 29, wherein said polypeptide further comprises:
a) an aspartic acid (D) at a position corresponding to amino acid position 2 in SEQ ID NO: 1;
b) a histidine (H) at a position corresponding to amino acid position 12 in SEQ ID NO: 1;
c) an isoleucine (I) at a position corresponding to amino acid position 16 in SEQ ID NO: 1;
d) a serine (S) or an alanine (A) at a position corresponding to amino acid position 19 in SEQ ID NO: 1;
e) a cysteine (C) at a position corresponding to amino acid position 22 in SEQ ID NO: 1;
f) a leucine (L) at a position corresponding to amino acid position 23 in SEQ ID NO: 1;
g) a methionine (M) at a position corresponding to amino acid position 24 in SEQ ID NO: 1;
h) an arginine (R) or an alanine (A) at a position corresponding to amino acid position 28 in SEQ ID NO: 1;
i) an arginine (R), alanine (A), glutamine (Q), cysteine (C), glycine (G), serine (S), threonine (T), leucine (L), glutamic acid (E), or a proline (P) at a position corresponding to amino acid position 30 in SEQ ID NO: 1;
j) an arginine (R) at a position corresponding to amino acid position 31 in SEQ ID NO: 1;
k) an arginine (R), alanine (A), lysine (K) glutamine (Q), glycine (G) or a leucine (L) at a position corresponding to amino acid position 32 in SEQ ID NO: 1;
l) an asparagine (N) at a position corresponding to amino acid position 36 in SEQ ID NO: 1;
m) a leucine (L) at a position corresponding to amino acid position 43 in SEQ ID NO: 1;
n) an arginine (R) or lysine (K) at a position corresponding to amino acid position 50 in SEQ ID NO: 1;
o) an isoleucine (I) or a leucine (L) at a position corresponding to amino acid position 54 in SEQ ID NO: 1;
p) a leucine (L) at a position corresponding to amino acid position 56 in SEQ ID NO: 1;
q) a glutamic acid (E) at a position corresponding to amino acid position 57 in SEQ ID NO: 1;
r) an isoleucine (I) at a position corresponding to amino acid position 58 in SEQ ID NO: 1;
s) a histidine (H) or alanine (A) at a position corresponding to amino acid position 59 in SEQ ID NO: 1;
t) a valine (V) at a position corresponding to amino acid position 62 in SEQ ID NO: 1;
u) a lysine (K) at a position corresponding to amino acid position 71 in SEQ ID NO: 1;
v) a threonine (T) at a position corresponding to amino acid position 72 in SEQ ID NO: 1;
w) an alanine (A) at a position corresponding to amino acid position 73 in SEQ ID NO: 1;
x) a glycine (G) at a position corresponding to amino acid position 79 in SEQ ID NO: 1;
y) an arginine (R) at a position corresponding to amino acid position 80 in SEQ ID NO: 1;
z) a lysine (K) at a position corresponding to amino acid position 81 in SEQ ID NO: 1;
aa) an arginine (R) at a position corresponding to amino acid position 82 in SEQ ID NO: 1;
bb) an aspartic acid (D) at a position corresponding to amino acid position 86 in SEQ ID NO: 1;
cc) a leucine (L) at a position corresponding to amino acid position 87 in SEQ ID NO: 1;
dd) an isoleucine (I) at a position corresponding to amino acid position 91 in SEQ ID NO: 1;
ee) an isoleucine (I) at a position corresponding to amino acid position 95 in SEQ ID NO: 1;
ff) an arginine (R) at a position corresponding to amino acid position 98 in SEQ ID NO: 1;
gg) a valine (V) at a position corresponding to amino acid position 103 in SEQ ID NO: 1;
hh) an alanine (A) at a position corresponding to amino acid position 105 in SEQ ID NO: 1;
ii) an arginine (R) at a position corresponding to amino acid position 111 in SEQ ID NO: 1;
jj) a serine (S) at a position corresponding to amino acid position 113 in SEQ ID NO: 1;
kk) a proline (P) at a position corresponding to amino acid position 114 in SEQ ID NO: 1;
ll) an arginine (R) at a position corresponding to amino acid position 116 in SEQ ID NO: 1;

mm) a an glycine (G) at a position corresponding to amino acid position 117 in SEQ ID NO: 1;
nn) a threonine (T) at a position corresponding to amino acid position 118 in SEQ ID NO: 1;
oo) a an glycine (G) at a position corresponding to amino acid position 121 in SEQ ID NO: 1;
pp) an arginine (R) at a position corresponding to amino acid position 124 in SEQ ID NO: 1;
qq) a cysteine (C) at a position corresponding to amino acid position 128 in SEQ ID NO: 1;
rr) an alanine (A) at a position corresponding to amino acid position 129 in SEQ ID NO: 1;
ss) an arginine (R) at a position corresponding to amino acid position 131 in SEQ ID NO: 1;
tt) a valine (V) at a position corresponding to amino acid position 132 in SEQ ID NO: 1;
uu) a serine (S) at a position corresponding to amino acid position 147 in SEQ ID NO: 1;
vv) an alanine (A) at a position corresponding to amino acid position 151 in SEQ ID NO: 1;
ww) a leucine (L) or a methionine (M) at a position corresponding to amino acid position 153 in SEQ ID NO: 1;
xx) a tryptophan (W) at a position corresponding to amino acid position 159 in SEQ ID NO: 1;
yy) a glutamic acid (E) at a position corresponding to amino acid position 160 in SEQ ID NO: 1;
zz) a valine (V) at a position corresponding to amino acid position 161 in SEQ ID NO: 1;
aaa) a tyrosine (Y) at a position corresponding to amino acid position 162 in SEQ ID NO: 1;
bbb) an arginine (R) at a position corresponding to amino acid position 163 in SEQ ID NO: 1;
ccc) a histidine (H) at a position corresponding to amino acid position 164 in SEQ ID NO: 1;
ddd) a leucine (L) at a position corresponding to amino acid position 165 in SEQ ID NO: 1;
eee) an arginine (R) at a position corresponding to amino acid position 166 in SEQ ID NO: 1;
fff) a histidine (H) at a position corresponding to amino acid position 167 in SEQ ID NO: 1;
ggg) a proline (P) at a position corresponding to amino acid position 168 in SEQ ID NO: 1;
hhh) an alanine (A) at a position corresponding to amino acid position 169 in SEQ ID NO: 1;
iii) a proline (P) at a position corresponding to amino acid position 170 in SEQ ID NO: 1;
jjj) a histidine (H) at a position corresponding to amino acid position 171 in SEQ ID NO: 1;
kkk) a proline (P) at a position corresponding to amino acid position 172 in SEQ ID NO: 1;
lll) an arginine (R) at a position corresponding to amino acid position 173 in SEQ ID NO: 1;
mmm) a leucine (L) at a position corresponding to amino acid position 174 in SEQ ID NO: 1;
nnn) a proline (P) at a position corresponding to amino acid position 175 in SEQ ID NO: 1;
ooo) a glutamine (Q) at a position corresponding to amino acid position 176 in SEQ ID NO: 1;
ppp) an alanine (A) at a position corresponding to amino acid position 177 in SEQ ID NO: 1;
qqq) an arginine (R) at a position corresponding to amino acid position 178 in SEQ ID NO: 1;
rrr) a valine (V) at a position corresponding to amino acid position 179 in SEQ ID NO: 1;
sss) a glutamine (Q) at a position corresponding to amino acid position 180 in SEQ ID NO: 1;
ttt) a valine (V) at a position corresponding to amino acid position 182 in SEQ ID NO: 1;
uuu) a proline (P) at a position corresponding to amino acid position 183 in SEQ ID NO: 1;
vvv) a lysine (K) at a position corresponding to amino acid position 184 in SEQ ID NO: 1;
www) a threonine (T) or a histidine (H) at a position corresponding to amino acid position 185 in SEQ ID NO: 1;
xxx) a serine (S) at a position corresponding to amino acid position 186 in SEQ ID NO: 1;
yyy) a glutamic acid (E) at a position corresponding to amino acid position 187 in SEQ ID NO: 1;
zzz) a leucine (L) at a position corresponding to amino acid position 188 in SEQ ID NO: 1;
aaaa) a glutamic acid (E) at a position corresponding to amino acid position 189 in SEQ ID NO: 1;
bbbb) a glutamine (Q) at a position corresponding to amino acid position 190 in SEQ ID NO: 1;
cccc) a leucine (L) at a position corresponding to amino acid position 191 in SEQ ID NO: 1;
dddd) an amino acid deletion at a position corresponding to amino acid position 192 in SEQ ID NO: 1;
eeee) a proline (P) at a position corresponding to amino acid position 194 in SEQ ID NO: 1;
ffff) a lysine (K) at a position corresponding to amino acid position 195 in SEQ ID NO: 1;
gggg) a serine (S) at a position corresponding to amino acid position 196 in SEQ ID NO: 1;
hhhh) a phenylalanine (F) at a position corresponding to amino acid position 197 in SEQ ID NO: 1;
iiii) an isoleucine (I) at a position corresponding to amino acid position 200 in SEQ ID NO: 1;
jjjj) a valine (V) at a position corresponding to amino acid position 203 in SEQ ID NO: 1;
kkkk) a leucine (L) at a position corresponding to amino acid position 204 in SEQ ID NO: 1;
llll) an alanine (A) or a serine (S) at a position corresponding to amino acid position 206 in SEQ ID NO: 1;
mmmm) a cysteine (C) at a position corresponding to amino acid position 209 in SEQ ID NO: 1;
nnnn) a leucine (L) at a position corresponding to amino acid position 222 in SEQ ID NO: 1;
oooo) a methionine (M) at a position corresponding to amino acid position 211 in SEQ ID NO: 1;
pppp) an isoleucine (I) at a position corresponding to amino acid position 232 in SEQ ID NO: 1;
qqqq) a serine (S) at a position corresponding to amino acid position 236 in SEQ ID NO: 1;
rrrr) a leucine (L) or an arginine (R) at a position corresponding to amino acid position 237 in SEQ ID NO: 1;
ssss) an isoleucine (I) or a leucine (L) at a position corresponding to amino acid position 241 in SEQ ID NO: 1;
tttt) a glutamic acid (E) at a position corresponding to amino acid position 244 in SEQ ID NO: 1;
uuuu) a histidine (H) at a position corresponding to amino acid position 246 in SEQ ID NO: 1;
vvvv) an aspartic acid (D) or histidine (H) at a position corresponding to amino acid position 253 in SEQ ID NO: 1;
wwww) an isoleucine (I) at a position corresponding to amino acid position 254 in SEQ ID NO: 1;
xxxx) a serine (S) at a position corresponding to amino acid position 258 in SEQ ID NO: 1;

yyyy) an arginine (R) at a position corresponding to amino acid position 267 in SEQ ID NO: 1;

zzzz) an isoleucine (I) at a position corresponding to amino acid position 278 in SEQ ID NO: 1;

aaaaa) a tyrosine (Y) at a position corresponding to amino acid position 281 in SEQ ID NO: 1;

bbbbb) a phenylalanine (F) at a position corresponding to amino acid position 282 in SEQ ID NO: 1;

ccccc) a threonine (T) at a position corresponding to amino acid position 289 in SEQ ID NO: 1;

ddddd) an alanine (A) at a position corresponding to amino acid position 292 in SEQ ID NO: 1;

eeeee) a glycine (G) at a position corresponding to amino acid position 308 in SEQ ID NO: 1;

fffff) an arginine (R) at a position corresponding to amino acid position 311 in SEQ ID NO: 1;

ggggg) an alanine (A) at a position corresponding to amino acid position 312 in SEQ ID NO: 1;

hhhhh) an alanine (A) at a position corresponding to amino acid position 316 in SEQ ID NO: 1;

iiiii) an arginine (R) at a position corresponding to amino acid position 318 in SEQ ID NO: 1 jjjjj) a valine (V) at a position corresponding to amino acid position 319 in SEQ ID NO: 1;

kkkkk) an alanine (A) at a position corresponding to amino acid position 334 in SEQ ID NO: 1;

lllll) a phenylalanine (F) at a position corresponding to amino acid position 339 in SEQ ID NO: 1;

mmmmm) a glycine (G) or a leucine (L) at a position corresponding to amino acid position 340 in SEQ ID NO: 1;

nnnnn) a serine (S) at a position corresponding to amino acid position 342 in SEQ ID NO: 1;

ooooo) an asparagine (N) at a position corresponding to amino acid position 345 in SEQ ID NO: 1;

ppppp) an asparagine (N) at a position corresponding to amino acid position 346 in SEQ ID NO: 1; or, qqqqq) an asparagine (N) at a position corresponding to amino acid position 348 in SEQ ID NO: 1; or, rrrrr) any combination of a) to qqqqq).

33. The isolated polypeptide of embodiment 29 selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402, 430, 431, 432 and 433.

34. The isolated polypeptide of embodiment 29, wherein the polypeptide is capable of recognizing and cleaving a meganuclease recognition sites selected from the group consisting of SEQ ID NO: 2 (LIG3-4), SEQ ID NO: 85 (MHP77), SEQ ID NO:269 (MS26), SEQ ID NO:281 (MHP14), SEQ ID NO: 331(MP107), SEQ ID NO:358 (ZM6.3), SEQ ID NO:390 (ZM6.22v2), SEQ ID NO:423 or SEQ ID NO:424.

35. The isolated polypeptide of embodiment 29, wherein said polypeptide has an increased meganuclease activity when compared to a control meganuclease that lacks said amino acid modification.

36. The isolated polypeptide of embodiment 29, wherein said control meganuclease is selected from the group of SEQ ID NO:1 (LIG3-4), SEQ ID NO: 86 (MHP77), SEQ ID NO: 250 (MHP77.3), SEQ ID NO:270 (MS26+), SEQ ID NO:271, SEQ ID NO:282 (MHP14), SEQ ID NO:283 (MHP14+), SEQ ID NO: 329 (MP107), SEQ ID NO:356 (ZM6.3), SEQ ID NO:389 (ZM6.22v2), SEQ ID NO:429 or SEQ ID NO:435.

37. The isolated polypeptide of embodiment 29, wherein the increased meganuclease activity is evidenced by:

a) a higher yeast assay score when compared to the control meganuclease that lacks said amino acid modification; or, b) a higher target site mutation rate when compared to the control meganuclease that lacks said amino acid modification; or, c) a higher in-vitro cutting when compared to the control meganuclease that lacks said amino acid modification; or, d) any combination of (a), (b) and (c).

38. A composition comprising at least one or more polypeptides of embodiment 29.

39. A method for producing a meganuclease having increased activity over a range of temperatures, the method comprising:

a) producing a variant meganuclease by modifying at least one amino acid at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346 348 and combinations thereof; and, b) selecting said variant meganuclease from step a) and screening said variant meganuclease for the ability to cleave a DNA target sequence over a range of temperatures between and including 16° C. to 37° C.

40. The method of embodiment 39, wherein said range of temperatures comprises:

a) 16° C.;
b) 18° C.;
c) 20° C.;
d) 24° C.;
e) 28° C.;
f) 30° C.;
g) 37° C.; or,
h) any combination of a), b), c), d), e), f), h), g) and g).

41. A method for producing a meganuclease having an increased meganuclease activity when compared to a control meganuclease, the method comprising:

a) producing a variant meganuclease by modifying at least one amino acid at an amino acid position corresponding to a position of SEQ ID NO:1 selected from the group consisting of positions 2, 12, 16, 22, 23, 31, 36, 43, 50, 56, 58, 59, 62, 71, 72, 73, 80, 81, 82, 86, 91, 95, 98, 103, 113, 114, 116, 117, 118, 121, 124, 128, 129, 131, 147, 151, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 194, 195, 196, 197, 200, 203, 204, 209, 222, 232, 236, 237, 246, 254, 258, 267, 278, 281, 282, 289, 308, 311, 312, 316, 318, 319, 334, 339, 340, 342, 345, 346, 348 and combinations thereof; and, b) selecting the variant meganuclease from step a) and screening said variant for increased meganuclease activity when compared to a control meganuclease.

42. The method of embodiment 41, wherein the increased meganuclease activity is evidenced by:
a) a higher yeast assay score when compared to the control meganuclease that lacks said amino acid modification; or,
b) a higher target site mutation rate when compared to the control meganuclease that lacks said amino acid modification; or,
c) a higher in-vitro cutting when compared to the control meganuclease that lacks said amino acid modification; or,
d) any combination of (a), (b) and (c).

43. The isolated or recombinant polynucleotide of embodiment 1, wherein said meganuclease polypeptide comprises a linker polypeptide, wherein said linker polypeptide comprises:
a) SEQ ID NO:420;
b) SEQ ID NO:421;
c) SEQ ID NO:422; or,
d) an amino acid sequence consisting of any possible amino acid at positions corresponding to positions 156 to 193 of SEQ ID NO:1.

44. A composition comprising at least one or more polynucleotides of embodiment 1.

45. An isolated or recombinant polynucleotide encoding a meganuclease polypeptide, said polypeptide comprising an amino acid sequence having at least one amino acid modification at an amino acid position corresponding to a position of SEQ ID NO:1 selected from the group consisting of positions 16, 22, 50, 56, 59, 71, 81, 103, 121, 153, 185, 209, 222, 246, 258, 281, 308, 316, 345, 346, and combinations thereof, and wherein the polypeptide is capable of recognizing and cleaving a meganuclease target site comprising SEQ ID NO: 2.

46. The isolated or recombinant polynucleotide of embodiment 45, wherein said nucleotide sequence encodes a meganuclease polypeptide having at least 80% sequence identity to SEQ ID NO: 1.

47. The isolated or recombinant polynucleotide of embodiment 45, wherein said at least one amino acid modification comprises any one of the amino acid modifications shown in FIG. 5A-FIG. 5E.

48. The isolated or recombinant polynucleotide of embodiment 45, wherein said nucleotide sequence encodes a meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37 and 38.

49. An isolated or recombinant polynucleotide encoding a meganuclease polypeptide, the polypeptide comprising an amino acid sequence having at least one amino acid modification at an amino acid position corresponding to a position of SEQ ID NO:86 selected from the group consisting of positions 2, 12, 16, 22, 23, 36, 43, 50, 56, 58, 59, 72, 73, 81, 86, 91, 95, 103, 113, 114, 120, 121, 124, 128, 129, 131, 151, 153, 200, 204, 209, 232, 236, 237, 246, 254, 258, 267, 281, 308, 311, 312, 316, 319, 334, 339, 340, 342, and combinations thereof, and wherein the polypeptide is capable of recognizing and cleaving a meganuclease target site comprising SEQ ID NO: 85.

50. The isolated or recombinant polynucleotide of embodiment 49, wherein said nucleotide sequence encodes a meganuclease polypeptide having at least 80% sequence identity to SEQ ID NO: 86.

51. The isolated or recombinant polynucleotide of embodiment 49, wherein said at least one amino acid modification comprises any one of the amino acid modifications shown in FIG. 9A-FIG. 9N.

52. The isolated or recombinant polynucleotide of embodiment 49, wherein said nucleotide sequence encodes a meganuclease polypeptide selected from the group consisting of SEQ ID NOs: 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252 and 253.

53. An isolated or recombinant polynucleotide encoding a meganuclease polypeptide, the polypeptide comprising an amino acid sequence having at least one amino acid modification at an amino acid position corresponding to a position of SEQ ID NO:270 selected from the group consisting of positions 16, 22, 50, 71, 185, 246, 258, 316 and combinations thereof, and wherein the polypeptide is capable of recognizing and cleaving a meganuclease target site comprising SEQ ID NO: 269.

54. The isolated or recombinant polynucleotide of embodiment 53, wherein said nucleotide sequence encodes a meganuclease polypeptide selected from the group consisting of SEQ ID NOs: 272, 273, 274 and 275.

55. An isolated or recombinant polynucleotide encoding a meganuclease polypeptide, the polypeptide comprising an amino acid sequence having at least one amino acid modification at an amino acid position corresponding to a position of SEQ ID NO:282 selected from the group consisting of positions 12, 16, 22, 31, 50, 56, 59, 62, 81, 98, 103, 105, 116, 118, 121, 153, 159, 160, 161, 162, 163, 164, 165, 166, 167, 168, 169, 170, 171, 172, 173, 174, 175, 176, 177, 178, 179, 180, 182, 183, 184, 185, 186, 187, 188, 189, 190, 191, 192, 258, 281, 308, 312, 316, 319, and combinations thereof, and wherein the polypeptide is capable of recognizing and cleaving a meganuclease target site comprising SEQ ID NO:281.

56. The isolated or recombinant polynucleotide of embodiment 55, wherein said nucleotide sequence encodes a meganuclease polypeptide having at least 80% sequence identity to SEQ ID NO: 282.

57. The isolated or recombinant polynucleotide of embodiment 55, wherein said at least one amino acid modification comprises any one of the amino acid modifications shown in FIG. 10A-FIG. 10D.

58. The isolated or recombinant polynucleotide of embodiment 55, wherein said nucleotide sequence encodes a meganuclease polypeptide selected from the group consisting of SEQ ID NOs: 284, 285, 286, 287, 288, 289, 290, 291, 292, 293, 294, 295, 296, 297 and 298.

59. An isolated or recombinant polynucleotide encoding a meganuclease polypeptide, the polypeptide comprising an amino acid sequence having at least one amino acid modification at an amino acid position corresponding to a position of SEQ ID NO:329 selected from the group consisting of positions 12, 32, 50, 56, 80, 105, 124, 129, 131, 153, 185, 311, 316, 318, 340, and combinations thereof, and wherein the polypeptide is capable of recognizing and cleaving a meganuclease target site comprising SEQ ID NO: 328.

60. The isolated or recombinant polynucleotide of embodiment 59, wherein said nucleotide sequence encodes a meganuclease polypeptide having at least 80% sequence identity to SEQ ID NO: 329.

61. The isolated or recombinant polynucleotide of embodiment 59, wherein said at least one amino acid modification comprises any one of the amino acid modifications shown in FIG. 11.

62. The isolated or recombinant polynucleotide of embodiment 59, wherein said nucleotide sequence encodes a meganuclease polypeptide selected from the group consisting of SEQ ID NOs: 330, 331, 332, 333, 334, 335, 336, 337, 338, 339, 340 and 341.

63. An isolated or recombinant polynucleotide encoding a meganuclease polypeptide, the polypeptide comprising an amino acid sequence having at least one amino acid modification at an amino acid position corresponding to a position of SEQ ID NO:356 selected from the group consisting of positions 12, 24, 36, 50, 56, 62, 73, 80, 124, 129, 147, 182, 203, 237, 252, 311, 316, 318, 340, 348, and combinations thereof, and wherein the polypeptide is capable of recognizing and cleaving a meganuclease target site comprising SEQ ID NO: 355.

64. The isolated or recombinant polynucleotide of embodiment 63, wherein said nucleotide sequence encodes a meganuclease polypeptide having at least 80% sequence identity to SEQ ID NO: 356.

65. The isolated or recombinant polynucleotide of embodiment 63, wherein said at least one amino acid modification comprises any one of the amino acid modifications shown in FIG. 12.

66. The isolated or recombinant polynucleotide of embodiment 63, wherein said nucleotide sequence encodes a meganuclease polypeptide selected from the group consisting of SEQ ID NOs: 357, 358, 359, 360, 361, 362, 363, 364, 365, 366, 367, 368, 369, 370, and 371.

67. An isolated or recombinant polynucleotide encoding a meganuclease polypeptide, the polypeptide comprising an amino acid sequence having at least one amino acid modification at an amino acid position corresponding to a position of SEQ ID NO:389 selected from the group consisting of positions 12, 50, 56, 124, 129, 131, 153, 211, 237, 311, 316, and position 318, and combinations thereof, and wherein the polypeptide is capable of recognizing and cleaving a meganuclease target site comprising SEQ ID NO: 388.

68. The isolated or recombinant polynucleotide of embodiment 67, wherein said nucleotide sequence encodes a meganuclease polypeptide having at least 80% sequence identity to SEQ ID NO: 389.

69. The isolated or recombinant polynucleotide of embodiment 67, wherein said at least one amino acid modification comprises any one of the amino acid modifications shown in FIG. 13.

70. The isolated or recombinant polynucleotide of embodiment 67, wherein said nucleotide sequence encodes a meganuclease polypeptide selected from the group consisting of SEQ ID NOs: 390, 391, 392, 393, 394, 395, 396, 397, 398, 399, 400, 401, 402, and 403.

72. A yeast, plant, plant cell, explant or seed comprising the meganuclease created by the method of embodiments 36-42.

73. A method of introducing a double-strand break in the genome of a yeast or plant cell, said method comprising:

a) contacting at least one plant or yeast cell comprising in its genome a meganuclease recognition site with a variant meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402 and 403, wherein the variant meganuclease is capable of inducing a double-strand break in said recognition site; and, b) selecting the yeast or plant cell from a) and screening said yeast or plant cell for any modification of said recognition sequence.

74. A method of integrating a polynucleotide of interest into a recognition site in the genome of a plant or yeast cell, the method comprising:

a) contacting at least one plant or yeast cell comprising in its genome a meganuclease recognition site with:

(i) a variant meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, 38, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 251, 252, 253, 272, 273, 274, 275, 272, 273, 274, 275, 284, 285, 286, 287, 288, 289, 290, 291, 292, 293, 294, 295, 296, 297, 298, 330, 331, 332, 333, 334, 335, 336, 337, 338, 339, 340, 341, 357, 358, 359, 360, 361, 362, 363, 364, 365, 366, 367, 368, 369, 370, 371, 390, 391, 392, 393, 394, 395, 396, 397, 398, 399, 400, 401, 402 and 403, wherein the variant meganuclease is capable of inducing a double-strand break in said recognition site; and, (ii) a DNA fragment containing a polynucleotide of interest;

b) selecting at least one plant or yeast cell comprising integration of the polynucleotide of interest cassette at the recognition site.

75. An isolated or recombinant polynucleotide encoding a meganuclease polypeptide, the polypeptide comprising an amino acid sequence having at least one amino acid modification at an amino acid position corresponding to a position of SEQ ID NO:429 selected from the group consisting of positions 16, 22, 50, 71, 185, 246, 258, 316 and combinations thereof, and wherein the polypeptide is capable of recognizing and cleaving a meganuclease target site comprising SEQ ID NO: 423.

76. The isolated or recombinant polynucleotide of embodiment 75, wherein said nucleotide sequence encodes a meganuclease polypeptide selected from the group consisting of SEQ ID NOs: 430, 431 and 432.

77. An isolated or recombinant polynucleotide encoding a meganuclease polypeptide of SEQ ID NOs: 436, wherein the polypeptide is capable of recognizing and cleaving a meganuclease target site comprising SEQ ID NO: 424.

EXPERIMENTAL

Example 1

Transformation of Maize Immature Embryos

Transformation can be accomplished by various methods known to be effective in plants, including particle-mediated delivery, *Agrobacterium*-mediated transformation, PEG-mediated delivery, and electroporation.

a. Particle-mediated Delivery

Transformation of maize immature embryos using particle delivery is performed as follows. Media recipes follow below.

The ears are husked and surface sterilized in 30% Clorox bleach plus 0.5% Micro detergent for 20 minutes, and rinsed two times with sterile water. The immature embryos are isolated and placed embryo axis side down (scutellum side up), 25 embryos per plate, on 560Y medium for 4 hours and then aligned within the 2.5-cm target zone in preparation for bombardment. Alternatively, isolated embryos are placed on 560L (Initiation medium) and placed in the dark at temperatures ranging from 26° C. to 37° C. for 8 to 24 hours prior to placing on 560Y for 4 hours at 26° C. prior to bombardment as described above.

Plasmids containing the double strand brake inducing agent and donor DNA are constructed using standard molecular biology techniques and co-bombarded with plasmids containing the developmental genes ODP2 (AP2 domain transcription factor ODP2 (Ovule development protein 2); US20090328252 A1) and Wushel (US2011/0167516).

The plasmids and DNA of interest are precipitated onto 0.6 µm (average diameter) gold pellets using a water-soluble cationic lipid Tfx™-50 (Cat# E1811, Promega, Madison, Wis., USA) as follows. DNA solution is prepared on ice using 1 g of plasmid DNA and optionally other constructs for co-bombardment such as 50 ng (0.5 l) of each plasmid containing the developmental genes ODP2 (AP2 domain transcription factor ODP2 (Ovule development protein 2); US20090328252 A1) and Wushel. To the pre-mixed DNA, 20 µl of prepared gold particles (15 mg/ml) and 5 l Tfx-50 is added in water and mixed carefully. Gold particles are pelleted in a microfuge at 10,000 rpm for 1 min and supernatant is removed. The resulting pellet is carefully rinsed with 100 ml of 100% EtOH without resuspending the pellet and the EtOH rinse is carefully removed. 105 l of 100% EtOH is added and the particles are resuspended by brief sonication. Then, 10 µl is spotted onto the center of each macrocarrier and allowed to dry about 2 minutes before bombardment.

Alternatively, the plasmids and DNA of interest are precipitated onto 1.1 µm (average diameter) tungsten pellets using a calcium chloride ($CaCl_2$) precipitation procedure by mixing 100 µl prepared tungsten particles in water, 10 µl (1 µg) DNA in Tris EDTA buffer (1 µg total DNA), 100 µl 2.5 M $CaCl_2$, and 10 µl 0.1 M spermidine. Each reagent is added sequentially to the tungsten particle suspension, with mixing. The final mixture is sonicated briefly and allowed to incubate under constant vortexing for 10 minutes. After the precipitation period, the tubes are centrifuged briefly, liquid is removed, and the particles are washed with 500 ml 100% ethanol, followed by a 30 second centrifugation. Again, the liquid is removed, and 105 µl 100% ethanol is added to the final tungsten particle pellet. For particle gun bombardment, the tungsten/DNA particles are briefly sonicated. 10 µl of the tungsten/DNA particles is spotted onto the center of each macrocarrier, after which the spotted particles are allowed to dry about 2 minutes before bombardment.

The sample plates are bombarded at level #4 with a Biorad Helium Gun. All samples receive a single shot at 450 PSI, with a total of ten aliquots taken from each tube of prepared particles/DNA.

Following bombardment, the embryos are incubated on 560P (maintenance medium) for 12 to 48 hours at temperatures ranging from 26 C to 37 C, and then placed at 26 C. After 5 to 7 days the embryos are transferred to 560R selection medium containing 3 mg/liter Bialaphos, and subcultured every 2 weeks at 26 C. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to a lighted culture room. Approximately 7-10 days later, developing plantlets are transferred to 272V hormone-free medium in tubes for 7-10 days until plantlets are well established. Plants are then transferred to inserts in flats (equivalent to a 2.5" pot) containing potting soil and grown for 1 week in a growth chamber, subsequently grown an additional 1-2 weeks in the greenhouse, then transferred to Classic 600 pots (1.6 gallon) and grown to maturity. Plants are monitored and scored for transformation efficiency, and/or modification of regenerative capabilities.

Initiation medium (560L) comprises 4.0 g/l N6 basal salts (SIGMA C-1416), 1.0 ml/l Eriksson's Vitamin Mix (1000×SIGMA-1511), 0.5 mg/l thiamine HCl, 20.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Maintenance medium (560P) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, 2.0 mg/l 2,4-D, and 0.69 g/l L-proline (brought to volume with D-I H2O following adjustment to pH 5.8 with KOH); 3.0 g/l Gelrite (added after bringing to volume with D-I H2O); and 0.85 mg/l silver nitrate (added after sterilizing the medium and cooling to room temperature).

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I H2O following adjustment to pH 5.8 with KOH); 3.0 g/l Gelrite (added after bringing to volume with D-I H2O); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I H2O) (Murashige and Skoog (1962) Physiol. Plant. 15:473), 100 mg/l myo-inositol, 0.5 mg/l zeatin, 60 g/l sucrose, and 1.0 ml/l of 0.1 mM abscisic acid (brought to volume with polished D-I H2O after adjusting to pH 5.6); 3.0 g/l Gelrite (added after bringing to volume with D-I H2O); and 1.0 mg/l indoleacetic acid and 3.0 mg/l bialaphos (added after sterilizing the medium and cooling to 60° C.).

Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H2O), 0.1 g/l myo-inositol, and 40.0 g/l sucrose (brought to volume with polished D-I H2O after adjusting pH to 5.6); and 6 g/l bacto-agar (added after bringing to volume with polished D-I H2O), sterilized and cooled to 60° C.

b. *Agrobacterium*-mediated Transformation

*Agrobacterium*-mediated transformation was performed essentially as described in Djukanovic et al. (2006) *Plant Biotech J* 4:345-57. Briefly, 10-12 day old immature embryos (0.8-2.5 mm in size) were dissected from sterilized kernels and placed into liquid medium (4.0 g/L N6 Basal Salts (Sigma C-1416), 1.0 ml/L Eriksson's Vitamin Mix (Sigma E-1511), 1.0 mg/L thiamine HCl, 1.5 mg/L 2,4-D, 0.690 g/L L-proline, 68.5 g/L sucrose, 36.0 g/L glucose, pH 5.2). After embryo collection, the medium was replaced with 1 ml *Agrobacterium* at a concentration of 0.35-0.45 OD550. Maize embryos were incubated with *Agrobacterium* for 5 min at room temperature, then the mixture was poured onto a media plate containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2,4-D, 0.690 g/L L-proline, 30.0 g/L sucrose, 0.85 mg/L silver nitrate, 0.1 nM acetosyringone, and 3.0 g/L Gelrite, pH 5.8. Embryos were incubated axis down, in the dark for 3 days at 20° C., then incubated 4 days in the dark at 28° C., then transferred onto new media plates containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2,4-D, 0.69 g/L L-proline, 30.0 g/L sucrose, 0.5 g/L MES buffer, 0.85 mg/L silver nitrate, 3.0 mg/L Bialaphos, 100 mg/L carbenicillin, and 6.0 g/L agar, pH 5.8. Embryos were subcultured every three weeks until transgenic events were identified. Somatic embryogenesis was induced by transferring a small amount of tissue onto regeneration medium (4.3 g/L MS salts (Gibco 11117), 5.0 ml/L MS Vitamins Stock Solution, 100 mg/L myo-inositol, 0.1 μM ABA, 1 mg/L IAA, 0.5 mg/L zeatin, 60.0 g/L sucrose, 1.5 mg/L Bialaphos, 100 mg/L carbenicillin, 3.0 g/L Gelrite, pH 5.6) and incubation in the dark for two weeks at 28° C. All material with visible shoots and roots were transferred onto media containing 4.3 g/L MS salts (Gibco 11117), 5.0 ml/L MS Vitamins Stock Solution, 100 mg/L myo-inositol, 40.0 g/L sucrose, 1.5 g/L Gelrite, pH 5.6, and incubated under artificial light at 28° C. One week later, plantlets were moved into glass tubes containing the same medium and grown until they were sampled and/or transplanted into soil.

Example 2

Transient Expression of BBM Enhances Transformation

Parameters of the transformation protocol can be modified to ensure that the BBM activity is transient. One such method involves precipitating the BBM-containing plasmid in a manner that allows for transcription and expression, but precludes subsequent release of the DNA, for example, by using the chemical PEI.

In one example, the BBM plasmid is precipitated onto gold particles with PEI, while the transgenic expression cassette (UBI::moPAT~GFPm::PinII; moPAT is the maize optimized PAT gene) to be integrated is precipitated onto gold particles using the standard calcium chloride method.

Briefly, gold particles were coated with PEI as follows. First, the gold particles were washed. Thirty-five mg of gold particles, 1.0 in average diameter (A.S.I. #162-0010), were weighed out in a microcentrifuge tube, and 1.2 ml absolute EtOH was added and vortexed for one minute. The tube was incubated for 15 minutes at room temperature and then centrifuged at high speed using a microfuge for 15 minutes at 4° C. The supernatant was discarded and a fresh 1.2 ml aliquot of ethanol (EtOH) was added, vortexed for one minute, centrifuged for one minute, and the supernatant again discarded (this is repeated twice). A fresh 1.2 ml aliquot of EtOH was added, and this suspension (gold particles in EtOH) was stored at −20° C. for weeks. To coat particles with polyethylimine (PEI; Sigma #P3143), 250 μl of the washed gold particle/EtOH mix was centrifuged and the EtOH discarded. The particles were washed once in 100 μl ddH2O to remove residual ethanol, 250 μl of 0.25 mM PEI was added, followed by a pulse-sonication to suspend the particles and then the tube was plunged into a dry ice/EtOH bath to flash-freeze the suspension, which was then lyophilized overnight. At this point, dry, coated particles could be stored at −80° C. for at least 3 weeks. Before use, the particles were rinsed 3 times with 250 μl aliquots of 2.5 mM HEPES buffer, pH 7.1, with 1× pulse-sonication, and then a quick vortex before each centrifugation. The particles were then suspended in a final volume of 250 μl HEPES buffer. A 25 μl aliquot of the particles was added to fresh tubes before attaching DNA. To attach uncoated DNA, the particles were pulse-sonicated, then 1 μg of DNA (in 5 μl water) was added, followed by mixing by pipetting up and down a few times with a Pipetteman and incubated for 10 minutes. The particles were spun briefly (i.e. 10 seconds), the supernatant removed, and 60 μl EtOH added. The particles with PEI-precipitated DNA-1 were washed twice in 60 μl of EtOH. The particles were centrifuged, the supernatant discarded, and the particles were resuspended in 45 μl water. To attach the second DNA (DNA-2), precipitation using TFX-50 was used. The 45 μl of particles/DNA-1 suspension was briefly sonicated, and then 5 μl of 100 ng/μl of DNA-2 and 2.5 μl of TFX-50 were added. The solution was placed on a rotary shaker for 10 minutes, centrifuged at 10,000 g for 1 minute. The supernatant was removed, and the particles resuspended in 60 μl of EtOH. The solution was spotted onto macrocarriers and the gold particles onto which DNA-1 and DNA-2 had been sequentially attached were delivered into scutellar cells of 10 DAP Hi-II immature embryos using a standard protocol for the PDS-1000. For this experiment, the DNA-1 plasmid contained a UBI::RFP::pinII expression cassette, and DNA-2 contained a UBI::CFP::pinII expression cassette. Two days after bombardment, transient expression of both the CFP and RFP fluorescent markers was observed as numerous red & blue cells on the surface of the immature embryo. The embryos were then placed on non-selective culture medium and allowed to grow for 3 weeks before scoring for stable colonies. After this 3-week period, 10 multicellular, stably-expressing blue colonies were observed, in comparison to only one red colony. This demonstrated that PEI-precipitation could be used to effectively introduce DNA for transient expression while dramatically reducing integration of the PEI-introduced DNA and thus reducing the recovery of RFP-expressing transgenic events. In this manner, PEI-precipitation can be used to deliver transient expression of BBM and/or WUS2.

For example, the particles are first coated with UBI::BBM::pinII using PEI, then coated with UBI::moPAT~YFP using TFX-50, and then bombarded into scutellar cells on the surface of immature embryos. PEI-mediated precipitation results in a high frequency of transiently expressing cells on the surface of the immature embryo and extremely low frequencies of recovery of stable transformants (relative to the TFX-50 method). Thus, it is expected that the PEI-precipitated BBM cassette expresses transiently and stimulates a burst of embryogenic growth on the bombarded surface of the tissue (i.e. the scutellar surface), but this plasmid will not integrate. The PAT~GFP plasmid released from the Ca++/gold particles is expected to integrate and express the selectable marker at a frequency that results in substantially improved recovery of transgenic events. As a control treatment, PEI-precipitated particles containing a UBI::GUS::pinII (instead of BBM) are mixed with the PAT~GFP/Ca++ particles. Immature embryos from both treatments are moved onto culture medium containing 3 mg/l bialaphos. After 6-8 weeks, it is expected that GFP+, bialaphos-resistant calli will be observed in the PEI/BBM treatment at a much higher frequency relative to the control treatment (PEI/GUS).

As an alternative method, the BBM plasmid is precipitated onto gold particles with PEI, and then introduced into scutellar cells on the surface of immature embryos, and subsequent transient expression of the BBM gene elicits a rapid proliferation of embryogenic growth. During this period of induced growth, the explants are treated with Agrobacterium using standard methods for maize (see Example 1), with T-DNA delivery into the cell introducing a transgenic expression cassette such as UM::moPAT~GFPm::pinII. After co-cultivation, explants are allowed to recover on normal culture medium, and then are moved onto culture medium containing 3 mg/l bialaphos. After 6-8 weeks, it is expected that GFP+, bialaphos-resistant calli will be observed in the PEI/BBM treatment at a much higher frequency relative to the control treatment (PEI/GUS).

It may be desirable to "kick start" callus growth by transiently expressing the BBM and/or WUS2 polynucleotide products. This can be done by delivering BBM and WUS2 5'-capped polyadenylated RNA, expression cassettes containing BBM and WUS2 DNA, or BBM and/or WUS2 proteins. All of these molecules can be delivered using a biolistics particle gun. For example 5'-capped polyadenylated BBM and/or WUS2 RNA can easily be made in vitro using Ambion's mMessage mMachine kit. RNA is co-delivered along with DNA containing a polynucleotide of interest and a marker used for selection/screening such as Ubi::moPAT~GFPm::PinII. It is expected that the cells receiving the RNA will immediately begin dividing more rapidly and a large portion of these will have integrated the agronomic gene. These events can further be validated as being transgenic clonal colonies because they will also express the PAT~GFP fusion protein (and thus will display green fluorescence under appropriate illumination). Plants regenerated from these embryos can then be screened for the presence of the polynucleotide of interest.

Example 3

DNA Shuffling to Create Variants of LIG3-4 Meganuclease

A. LIG3-4 Meganuclease and LIG3-4 Recognition Sequence

An endogenous maize genomic target site comprising the LIG3-4 recognition sequence (SEQ ID NO: 2) was selected for design of a custom double-strand break inducing agent. The LIG3-4 recognition sequence is a 22 bp polynucleotide having the following sequence: ATATACCTCACACGTACGCGTA (SEQ ID NO: 2).

Wild type I-CreI meganuclease (SEQ ID NO: 3) was modified to produce the LIG3-4 meganuclease designed to recognize the LIG3-4 recognition sequence as described in US patent publication 2009-0133152 A1. Wild-type I-CreI meganuclease is a homodimer. In order to recognize the LIG3-4 recognition sequence, different substitutions were made to each monomer and the coding sequences for each monomer were joined by a linker sequence to produce a single-chain fusion polypeptide (LIG3-4, SEQ ID NO: 1)

B. Creation of LIG3-4 Meganuclease Variants

Variants of the LIG3-4 meganuclease were created through gene shuffling methods. Gene shuffling is an iterative process consisting of discrete cycles termed "rounds". Each round is a cycle of parent selection, library construction, gene evaluation and hit selection. The best hits from one round become the parental genes for the next round.

Figure 1A:
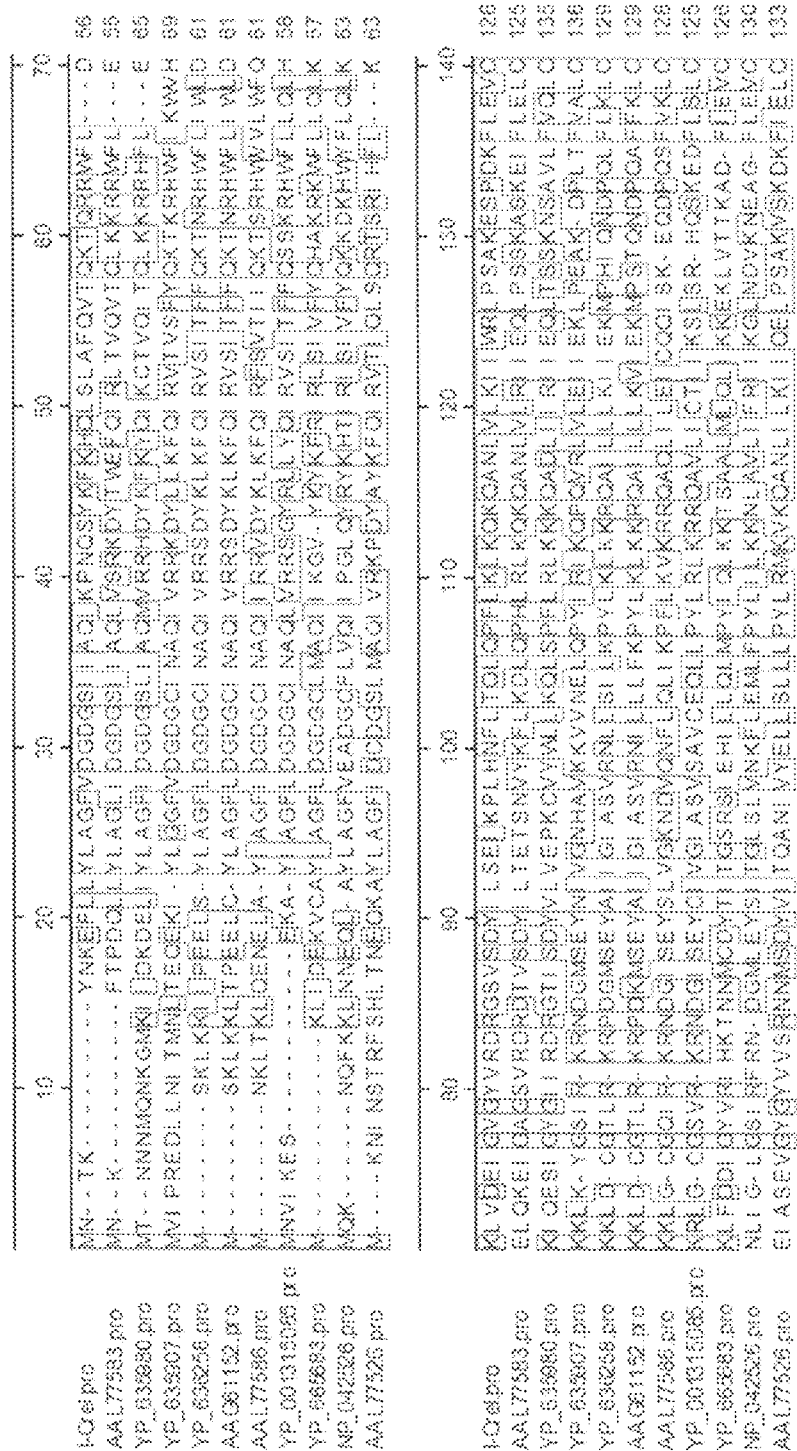
Figure 1B:
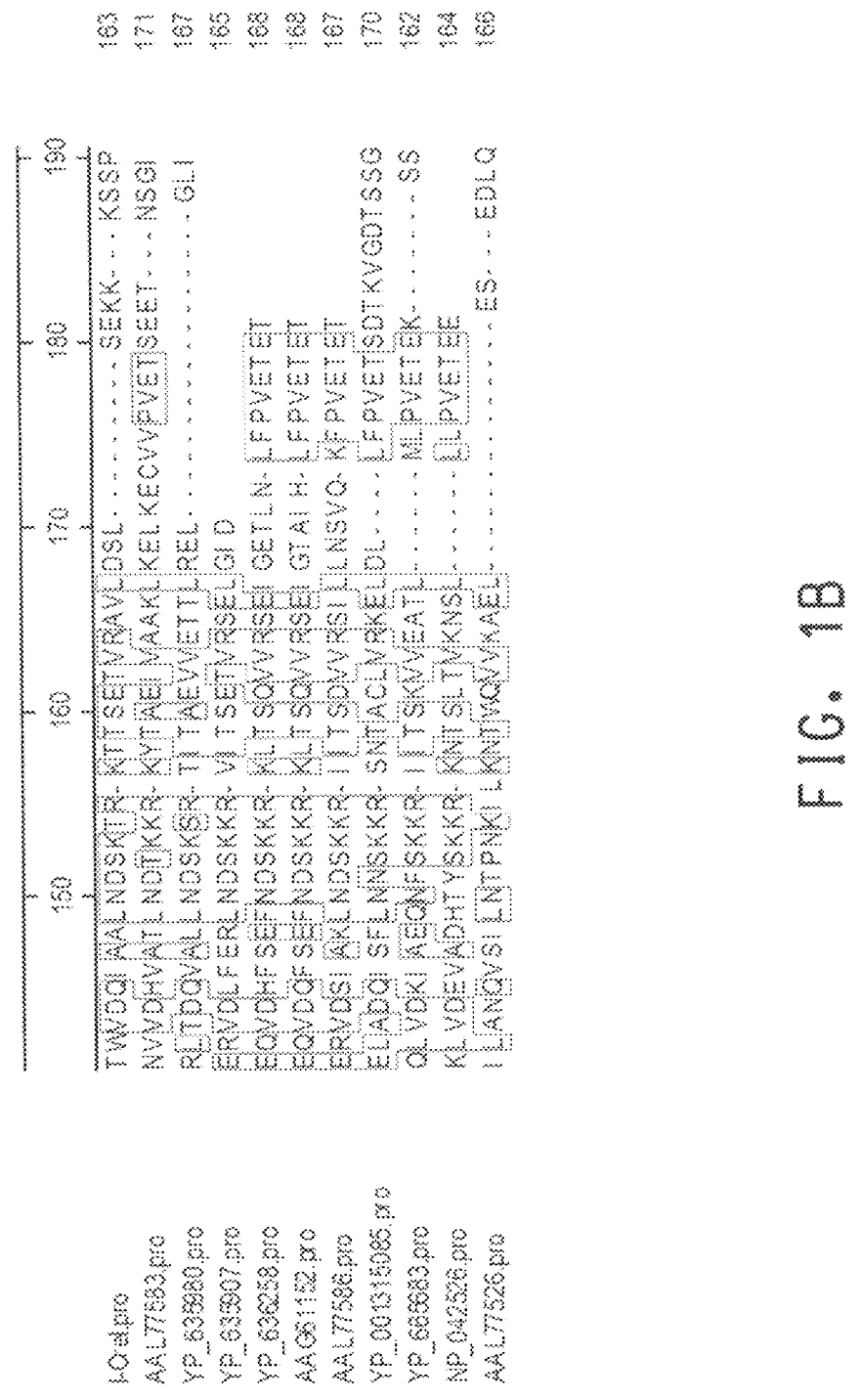

The first phase of LIG3-4 meganuclease optimization was designed to introduce amino acid substitutions as found in naturally occurring meganuclease proteins. Shuffled gene variant libraries were made based on the LIG3-4 protein template (SEQ ID NO: 1) using techniques including family shuffling, single-gene shuffling, back-crossing, semi-synthetic and synthetic shuffling (Zhang J-H et al. (1997) Proc Natl Acad Sci 94, 4504-4509; Crameri et al. (1998) Nature 391: 288-291; Ness et al. (2002) Nat Biotech 20:1251-1255). Libraries were based on phylogenetic sequence diversity, random mutagenesis, and structural features based on the crystal structure of I-CreI in Protein Data Bank (PDB). Phylogenetic diversity of several meganuclease proteins (SEQ ID NO: 4-13), including I-CreI (SEQ ID NO: 3) is shown in FIG. 1A-FIG. 1B. Diversity is defined as the amino acids present within the set of proteins at any position where all proteins do not contain the identical amino acid.

The shuffling process resulted in generation of LIG3-4 variants with recombinations of amino acid modifications, unintended amino acid modifications due to mutagenic PCR, deletions, and insertions (SEQ ID NOs:14-38). Corresponding DNA sequences for expression of these meganucleases in yeast are shown in SEQ ID NOs: 40-65).

Example 4

Yeast Screening System for Identification of Meganuclease Variants with Increased Activity Yeast screening strains were generated as hosts for the identification of meganuclease variants. The yeast Ade2 gene (Genetika 1987 Jul.-23(7):1141-8) (SEQ ID NO: 82) was used as a visible marker as well as a selection in the scheme depicted in FIG. 2. Gene fragments corresponding to the first 1000 nucleotides of the Ade2 coding sequence (SEQ ID NO: 83) (Ade2 5' fragment) and the last 1011 nucleotides of the Ade2 coding sequence (Ade2 3' fragment) were disrupted by a fragment including the yeast ura3 gene and meganuclease recognition sites. Three versions of the construct depicted in FIG. 2 were used. Plasmid pHD1327 (SEQ ID NO: 84) included the ZM6.3, ZM6.22, MHP42, MHP107 and LIG3-4 recognition sites. pVER8145 included the LIG3-4 recognition site, and pVER8189 included the MHP14, MHP77 and LIG3-4 recognition sites. There are 305 nucleotides of sequence duplication between the Ade2 5' fragment and the Ade2 3' fragment. The resulting constructs were used to replace the Ade2 gene (chromosome 15 nucleotide position 566193-564480) of yeast strain BY4247. The resulting yeast screening strains VER8145, VER8189 and HD1327 can be characterized as BY4742 MATa his3delta1 leu2delta0 lys2delta0 ura3delta0 Gal2+). If meganuclease cutting occurs between the duplicated sequences, homologous recombination can occur, resulting in a functional Ade2 gene.

The generation of a functional Ade2 gene can be used as a selection: when yeast cells are grown on media lacking adenine, only those with a functional Ade2 gene are able to grow.

The generation of a functional Ade2 gene can also be used as a screen. Yeast cells with a functional Ade2 gene are white, whereas those lacking Ade2 function exhibit red pigmentation due to accumulation of a metabolite earlier in the adenine biosynthetic pathway resulting in red colonies with white sectors as shown in FIGS. 2 and 3. The degree of white sectoring, sometimes extending to entire colonies, indicates the amount of meganuclease cutting activity. Since the sectoring phenotype is a qualitative measure of meganuclease activity, a 0-4 numerical scoring system was implemented. As shown in FIG. 3, a score of 0 indicates that no white sectors (no meganuclease cutting) were observed; a score of 4 indicates completely white colonies (complete cutting of the recognition site); scores of 1-3 indicate intermediate white sectoring phenotypes (and intermediate degrees of recognition site cutting).

Example 5

Meganuclease Expression Plasmid

Figure 4:
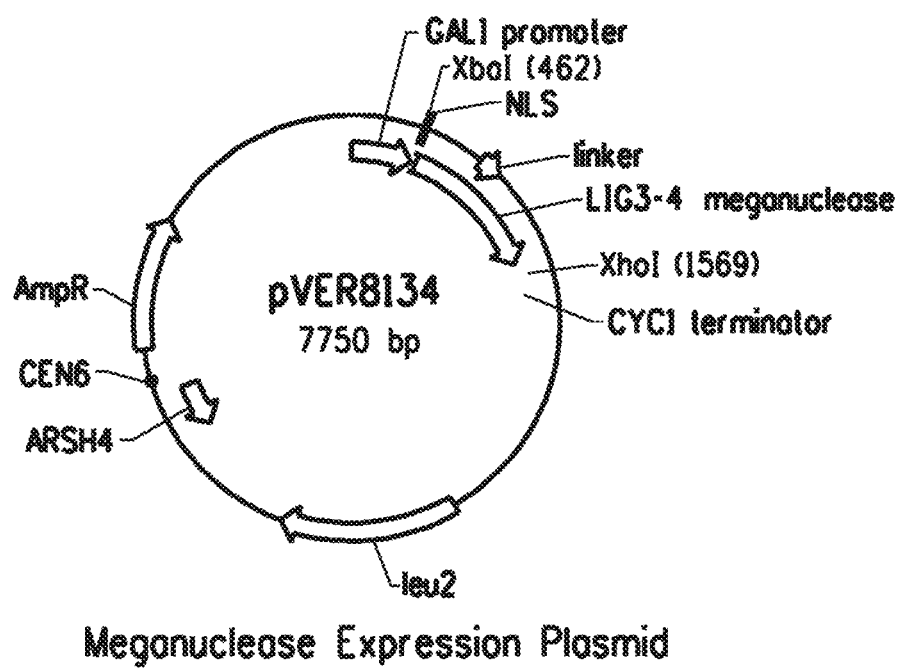
FIG. 4 shows the meganuclease expression plasmid pVER8134.
Figure 5A:
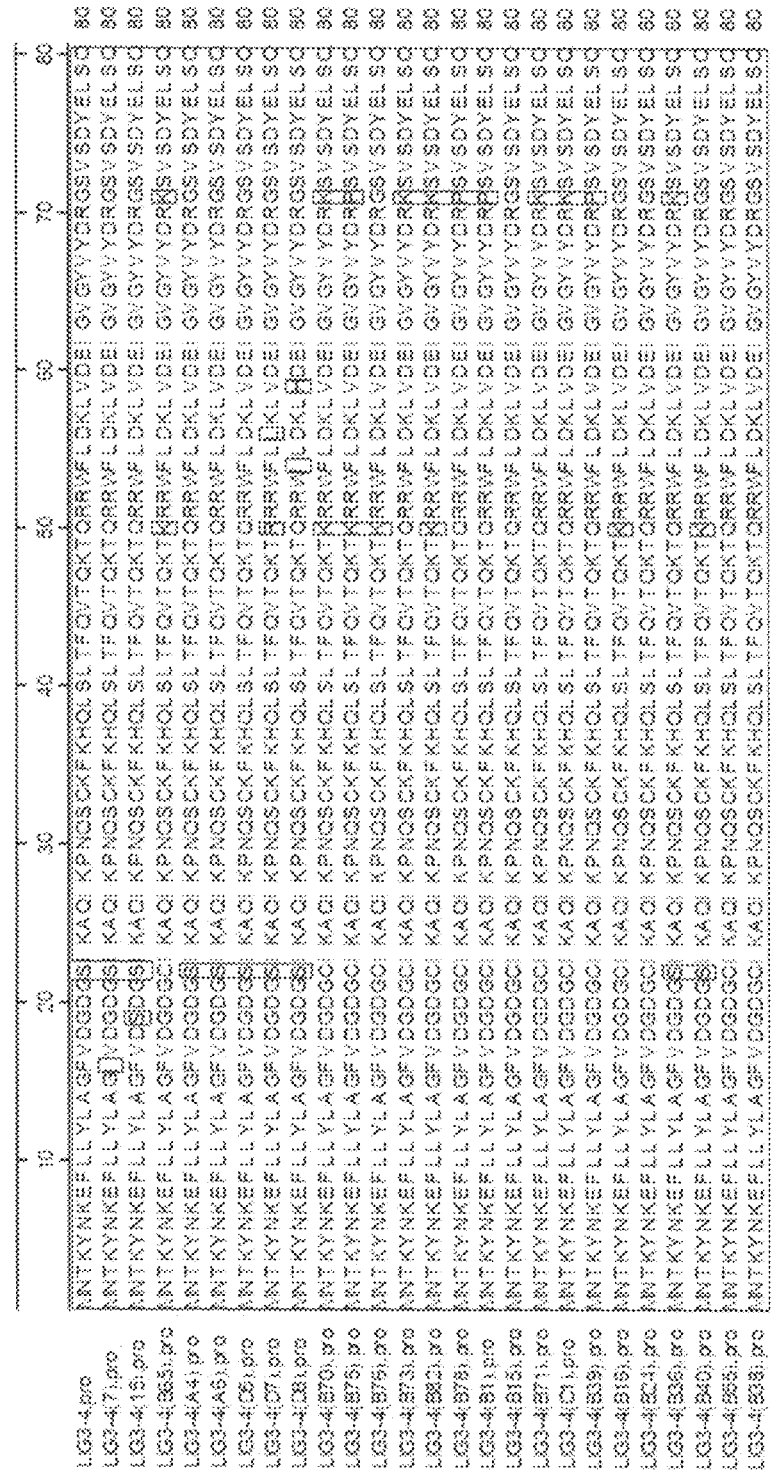

A meganuclease expression plasmid was constructed using the plasmid p415GAL1 (ATCC; Nucleic Acids Res. 1994 Dec. 25; 22(25):5767-8). The LIG3-4 coding sequence was PCR amplified using primers MN031 (SEQ ID NO: 66) and MN022 (SEQ ID NO: 67) and inserted in p415GAL1 as an XbaI-XhoI restriction fragment. The resulting construct (pVER8134; SEQ ID NO: 68) is shown in FIG. 4. The meganuclease expression plasmid contains a centromeric replication origin and a leu2 nutritional marker for growth in yeast as well as the F1 replication origin and an ampicillin antibiotic resistance gene for growth in E. coli. The meganuclease expression cassette consists of the galactose-inducible GAL1 promoter and the CYC1 terminator. The meganuclease coding sequence was preceded with a nuclear localization signal (SEQ ID NO: 69) encoding a 9 amino acid amino-terminal (MAPKKKRKV, SEQ ID NO: 70) and a carboxy-terminal 6× histidine tag (SEQ ID NO: 71) to aid protein purification.

Similar meganuclease expression plasmids were constructed by exchanging the LIG3-4 meganuclease (nucleotide positions 500-1549 of pVER8134, SEQ ID NO: 68) with a variant meganuclease.

Example 6

Transformation of the Yeast Screening Strain (YSS) and Screening for Meganuclease Activity in Yeast Shuffled meganuclease libraries (comprising the variant meganucleases) were inserted in the expression vector pVER8134 as described in Example 5 and transformed into a yeast screening strain comprising the corresponding meganuclease recognition site (Example 3) by the following procedure.

A 3 mL culture of selective media (MP Biomedical) was inoculated with a single colony of the yeast screening strain and grown at 30° C. overnight. On the following day, a 50 ml YPD culture (MP Biomedical) was started with 2 ml of the overnight culture and grown at 30° C. overnight. On the following day, the cells were harvested by centrifugation at 4000 rpm. The cells were resuspended in 100 ml ice cold water and centrifuged again. The cells were then washed in 1.2 M sorbitol, followed by treatment with 2 ml of 10 mM Tris pH 8.0, 1 mM EDTA, 100 mM Lithium acetate, 10 mM DTT, 0.6M sorbitol for 30 minutes at 30° C. with shaking. The cells were recovered by centrifugation, washed in 40 ml 1.2M sorbitol and finally resuspended in 250 microliters of 1.2M sorbitol. 50 microliter aliquots were transferred to test tubes on ice. Up to 5 microliters of DNA (100-500 nanograms) were added. The suspension was transferred to a 0.2 cm electroporation cuvette, on ice. Electroporation was performed with a pulse charge at 1.5 kV, 200 ohms, 25 microF (pulse time of 5 milliseconds). 1 mL YPD media (MP Biomedical) was added and the cells were allowed to recover at 30° C. for 1-2 hr. The cells were centrifuged, resuspended in 100 uL 1M sorbitol and plated on selective media lacking leucine and containing 2% galactose. The resulting yeast colonies were incubated at various temperatures ranging from 22 to 37 degrees Celsius for 7-10 days. I-CreI and meganucleases derived from it have maximal activity at or above 37 degrees Celsius. Screening was performed at a range of temperatures from 22 to 37 degrees in order to observe increases in activity at lower temperatures which are relevant to certain biological systems (eg. plant cells, plant cell cultures, etc). At that time the red/white sectoring phenotype, indicative of meganuclease activity was observed. Colonies with increased white sectoring over the parental meganuclease (indicating colonies expressing a meganuclease with increased meganuclease activity), also referred to as "hits" and sometimes completely white, were isolated for further analysis.

These potential "hits" were grown in liquid media to increase the cell density. DNA was extracted and used to transform E. coli. Plasmid DNA was extracted from E. coli cultures. The plasmid DNA corresponding to the potential hits was again transformed into the yeast screening strain as described above.

If the increase in white sectoring phenotype in yeast cells comprising the variant meganuclease (when compared to yeast comprising the parental meganuclease) was repeated, the variant was declared a "confirmed hit". Meganuclease coding sequences were determined for confirmed hits. Each confirmed hit represents a variant meganuclease and was assigned a meganuclease activity score at various temperatures based on the 0-4 scale described in Example 4.

Table 2 shows the activity of LIG3-4 and LIG3-4 variant meganucleases in Yeast Screening Strain VER8145 assayed at 22° C. and 30° C. with 2% galactose. A score of 0 indicates that no white sectors (no cutting indicating no meganuclease activity) was observed; a score of 4 indicates completely white colonies (complete cutting of the recognition site indicating high meganuclease activity); scores of 1-3 indicate intermediate white sectoring phenotypes (and intermediate degrees of recognition site cutting) was indicative of intermediate meganuclease activity.

TABLE 2

Activity of LIG3-4 and LIG3-4 variant Meganucleases in Yeast Screening Strain assayed at 22° C. and 30° C.

| SEQ ID NO: | Meganuclease | Assay score 22° C. | Assay score 30° C. |
|---|---|---|---|
| 1 | LIG3-4 | 0 | 2 |
| 27 | LIG3-4(B65) | 4 | 4 |
| 28 | LIG3-4(B70) | 4 | 4 |
| 31 | LIG3-4(B75) | 4 | 4 |
| 32 | LIG3-4(B76) | 4 | 4 |
| 30 | LIG3-4(B73) | 4 | 4 |
| 34 | LIG3-4(B82) | 4 | 4 |
| 33 | LIG3-4(B78) | 4 | 4 |
| 18 | LIG3-4(B1) | 3.5 | 4 |
| 15 | LIG3-4(15) | 3 | 4 |
| 38 | LIG3-4(D8) | 2.5 | 4 |
| 19 | LIG3-4(B15) | 2.5 | 4 |
| 35 | LIG3-4(C1) | 2 | 4 |
| 29 | LIG3-4(B71) | 2 | 4 |
| 24 | LIG3-4(B39) | 1 | 4 |
| 20 | LIG3-4(B16) | 0.5 | 4 |
| 37 | LIG3-4(D7) | 0.5 | 4 |
| 23 | LIG3-4(B38) | 0 | 4 |
| 25 | LIG3-4(B40) | 0 | 4 |
| 22 | LIG3-4(B36) | 0 | 4 |
| 21 | LIG3-4(B24) | 0 | 4 |
| 26 | LIG3-4(B55) | 0 | 4 |
| 16 | LIG3-4(A4) | 0 | 3.5 |
| 36 | LIG3-4(D5) | 1 | 3 |
| 14 | LIG3-4(7) | 1 | 3 |
| 17 | LIG3-4(A6) | 0 | 3 |

Alignment of the LIG3-4 variants relative to the LIG3-4 parent (LIG3-4.pro) is shown in FIG. 5A-FIG. 5E.

The various assay conditions are indicative of meganuclease activity, allowing a precise ranking of the shuffled variants by activity. Large increases in meganuclease activity (high scores) were observed. Complete cutting of the recognition site was observed with some variants even at the low temperature of 22° C. This is significant because the optimal temperature for I-Cre type meganucleases is 37° C., whereas the optimal temperature for certain biological systems (eg. plant cell cultures) is in the range of 22-25 degrees Celsius. Hence, these variant meganucleases that can cut at lower temperatures are better suited to function well in plant systems when compared to the parental I-Cre type meganuclease.

Table 3A and 3B represent the amino acid modifications of LIG3-4 variants relative to the LIG3-4 parental meganuclease.

TABLE 3A

Amino acid modifications of LIG3-4 variants relative to the LIG3-4.

| SEQ ID NO | Meganuclease | 16 | 19 | 22 | 50 | 54 | 56 | 59 | 71 | 81 | 103 | 121 | 132 | 153 |
|---|---|---|---|---|---|---|---|---|---|---|---|---|---|---|
| 1 | LIG3-4 | F | G | S | Q | F | D | V | G | I | N | K | I | D |
| 27 | LIG3-4(B65) | — | — | C | K | — | — | — | K | — | — | — | — | — |
| 28 | LIG3-4(B70) | — | — | C | K | — | — | — | K | — | — | — | — | — |
| 31 | LIG3-4(B75) | — | — | C | K | — | — | — | P | — | — | — | — | — |
| 32 | LIG3-4(B76) | — | — | C | K | — | — | — | — | — | — | — | — | — |
| 30 | LIG3-4(B73) | — | — | C | — | — | — | — | K | — | — | — | — | — |
| 34 | LIG3-4(B82) | — | — | C | K | — | — | — | K | — | — | — | — | — |
| 33 | LIG3-4(B78) | — | — | C | — | — | — | — | P | — | — | — | — | — |
| 18 | LIG3-4(B1) | — | — | C | — | — | — | — | P | — | — | — | — | — |
| 15 | LIG3-4(15) | — | S | — | — | — | — | — | — | — | — | — | — | — |
| 38 | LIG3-4(D8) | — | — | — | — | I | — | H | — | — | — | — | G | — |
| 19 | LIG3-4(B15) | — | — | C | — | — | — | — | — | — | — | — | — | — |
| 35 | LIG3-4(C1) | — | — | C | — | — | — | — | K | — | — | — | — | — |
| 29 | LIG3-4(B71) | — | — | C | — | — | — | — | K | — | — | — | — | — |
| 24 | LIG3-4(B39) | — | — | C | — | — | — | — | P | — | — | — | — | — |
| 20 | LIG3-4(B16) | — | — | C | K | — | — | — | — | — | — | — | — | — |
| 37 | LIG3-4(D7) | — | — | — | R | — | L | — | — | — | K | — | — | L |
| 23 | LIG3-4(B38) | — | — | C | — | — | — | — | — | — | — | — | — | — |
| 25 | LIG3-4(B40) | — | — | — | K | — | — | — | — | — | — | — | — | — |
| 22 | LIG3-4(B36) | — | — | — | — | — | — | — | K | — | — | — | — | — |
| 21 | LIG3-4(B24) | — | — | C | — | — | — | — | — | — | — | — | — | — |
| 26 | LIG3-4(B55) | — | — | C | — | — | — | — | — | — | — | — | — | — |
| 16 | LIG3-4(A4) | — | — | — | — | — | — | — | — | — | — | — | V | — |
| 36 | LIG3-4(D5) | — | — | — | — | — | — | — | — | K | V | — | — | M |
| 14 | LIG3-4(7) | I | — | — | — | — | — | — | — | — | — | — | — | — |
| 17 | LIG3-4(A6) | — | — | — | — | — | — | — | — | — | — | — | V | — |

TABLE 3B (continued from Table 3A)

| SEQ ID NO | Meganuclease | 185 | 209 | 222 | 244 | 246 | 258 | 281 | 308 | 316 | 319 | 345 | 346 |
|---|---|---|---|---|---|---|---|---|---|---|---|---|---|
| 1 | LIG3-4 | A | S | F | K | V | G | F | K | V | I | K | K |
| 27 | LIG3-4(B65) | — | — | — | — | — | K | — | — | — | — | — | — |
| 28 | LIG3-4(B70) | — | — | — | — | — | P | — | — | — | — | — | — |
| 31 | LIG3-4(B75) | — | — | — | — | — | K | — | — | — | — | — | — |

TABLE 3B-continued (continued from Table 3A)

| SEQ ID NO | Meganuclease | 185 | 209 | 222 | 244 | 246 | 258 | 281 | 308 | 316 | 319 | 345 | 346 |
|---|---|---|---|---|---|---|---|---|---|---|---|---|---|
| 32 | LIG3-4(B76) | — | — | — | — | — | K | — | — | — | — | — | — |
| 30 | LIG3-4(B73) | — | — | — | — | — | K | — | — | — | — | — | — |
| 34 | LIG3-4(B82) | — | C | — | — | — | K | — | — | — | — | — | — |
| 33 | LIG3-4(B78) | — | — | — | — | — | K | — | — | — | — | N | N |
| 18 | LIG3-4(B1) | — | — | — | — | — | K | — | — | — | — | — | — |
| 15 | LIG3-4(15) | — | — | — | — | — | — | — | — | — | — | — | — |
| 38 | LIG3-4(D8) | — | — | — | — | — | — | — | — | — | — | — | — |
| 19 | LIG3-4(B15) | — | — | — | — | — | K | — | — | — | — | — | — |
| 35 | LIG3-4(C1) | — | — | L | — | — | — | — | — | — | — | N | N |
| 29 | LIG3-4(B71) | — | — | — | — | — | P | — | — | — | — | — | — |
| 24 | LIG3-4(B39) | — | — | — | — | — | P | — | — | — | — | N | N |
| 20 | LIG3-4(B16) | — | — | — | — | — | — | — | — | — | — | — | — |
| 37 | LIG3-4(D7) | — | — | — | — | — | — | — | — | — | — | — | — |
| 23 | LIG3-4(B38) | — | — | — | — | — | P | — | — | — | — | — | — |
| 25 | LIG3-4(B40) | — | — | — | — | — | K | — | — | — | — | — | — |
| 22 | LIG3-4(B36) | — | — | — | — | — | K | — | — | — | — | — | — |
| 21 | LIG3-4(B24) | — | — | — | — | — | — | — | — | — | — | — | — |
| 26 | LIG3-4(B55) | — | C | — | — | — | K | — | — | — | — | — | — |
| 16 | LIG3-4(A4) | — | — | — | — | — | — | — | — | — | V | — | — |
| 36 | LIG3-4(D5) | — | — | — | — | H | — | — | G | — | — | — | — |
| 14 | LIG3-4(7) | G | — | — | E | — | — | — | — | A | — | — | — |
| 17 | LIG3-4(A6) | — | — | — | — | — | — | Y | — | — | — | — | — |

Example 7

Meganuclease Protein Production in *E. coli*

In order to further confirm and quantify the activity of meganuclease variants, meganuclease protein was produced in *E. coli* and subjected to in vitro cutting assay on plasmid or corn genomic DNA containing the meganuclease recognition site. Total DNA was extracted from yeast strains harboring the meganuclease variants. The meganuclease coding sequence was PCR amplified and inserted in the expression vector pQE80 (QIAgen). The resulting plasmid was transformed into *E. coli* strain BL21 (Stratagene) with growth on LB media containing 100 ppm carbenicillin. A suspension of cells was prepared from the solid media and used to inoculate a 50 ml culture of 2xYT media containing 100 ppm carbenicillin at an optical density of 0.2. The cultures were grown at 37 degrees. When the optical density reached 0.8, protein expression was induced by addition of IPTG. The temperature was adjusted to 20 degrees, and the culture was grown for an additional 2 hours. *E. coli* cells were harvested by centrifugation, resuspended in Buffer 1 (50 mM Tris pH8, 500 mM NaCl, 10 mM imidizole) and lysed by sonication. Cell debris was removed by centrifugation. The supernatant was transferred to a disposable column loaded with 0.5 ml Nickel-NTA Superflow resin (QIAgen). The column was washed with 4 ml Buffer 2 (50 mM Tris pH8, 500 mM NaCl, 60 mM imidizole). Purified meganuclease protein was eluted with 0.6 ml Buffer 4 (50 mM Tris pH8, 500 mM NaCl, 400 mM imidizole). The meganuclease protein was transferred to a Vivaspin500 concentrator. Buffer exchange and concentration with SAB buffer (25 mM Tris pH8, 100 mM NaCl, 10 mM MgCl$_2$, 5 mM EDTA) containing 50% glycerol, 0.5 mM dithiothreitol was preformed. A final volume of approximately 0.1 ml of purified meganuclease protein solution was recovered. Bovine serum albumin was added to a final concentration of 100 microgram per milliliter.

Example 8

In Vitro Assay for Meganuclease Activity

Meganuclease protein was isolated as described in Example 7. Protein concentration was determined visually on Nu-PAGE gels (Life Technologies) by calculating and then comparing band intensity with serially diluted samples of known concentration. DNA concentration was determined using a Hoechst dye fluorometric assay. Time-course digestions were carried out on plasmid DNA containing the meganuclease recognition site at 37° C., 28° C., and 23° C. with 25 nM of purified meganuclease protein and 0.25 nM of linearized plasmid substrate in digestion buffer (100 mM Tris-HCl (pH 7.9)/100 mM NaCl/10 mM MgCl$_2$/1 mM DTT/5 mM EDTA) in a final volume of 80 ul. 20 μl time-points were taken at 0, 25, 50, and 75 minutes and stopped with an equal volume of stop buffer (100 mM Tris-HCl, pH 8.0/600 mM NaCl/2% SDS/100 mM EDTA/1 mg of proteinase K per ml), incubated at 50° C. for 30-45 minutes, and purified with a Qiagen PCR purification column per the manufacturer's instruction. To quantify the % digestion of each sample or loss of meganuclease recognition sites, real-time PCR was performed on 1 μl of purified plasmid DNA diluted 50-fold in water with a TaqMan assay spanning the meganuclease recognition site. The loss of meganuclease recognition sites was calculated via the ΔΔCt method relative to an internal control TaqMan assay. The 0 minute timepoint or mock control was used as the calibrator. Timed digestions were carried out on genomic DNA at 37° C., 28° C., and 23° C. with 6.07 ug of corn genomic DNA and 16 nM of purified meganuclease protein in a final volume of 80 ul. After 50 minutes, digestion reactions were stopped as described above and purified by phenol/chloroform extraction and ethanol precipitated in the presence of 0.2M NaCl. Precipitated genomic DNA was washed twice with 70% ethanol, dried, and resuspended in 34 μl of water. The percent digestion of each sample was quantified by real-time PCR as described above for plasmid substrate except 1 μl of undiluted genomic DNA was assayed by real-time PCR. Since the cleavage activity of the I-CreI endonuclease has been demonstrated to be sensitive to temperatures below 37° C. (Wang, J., Kim, H., Yuan, X. and Herrin, D. (1997) *Nucleic Acids Res.* 25, 3767-3776.), in vitro assays to assess cleavage activity of the I-CreI derived parental meganuclease and its variants were carried out at 37° C., 28° C., and 23° C.

In-Vitro Meganuclease Activity of LIG3-4 and LIG3-4 Variants

On plasmid DNA containing the LIG3-4 recognition site, LIG3-4(B65) was the most active variant sustaining cleavage activity at 23° C. while little if any cleavage was detected for LIG3-4 and only slight cleavage was detected for LIG3-4(7) and LIG3-4(15) (FIG. 6A). At 28° C., hit15 and hit 7 achieved 66% and 50% cleavage, respectively, after 75 minutes while only slight cleavage was detected for LIG3-4 (FIG. 6B). At 37° C., hit7 demonstrated cleavage activity similar to LIG3-4 while hit15 and B65 cleaved the plasmid substrate more rapidly and to a greater extent (FIG. 6C). Based on plasmid DNA cleavage, all of the shuffled variants were more active than LIG3-4 with B65 being the most active variant followed in activity by hit15 and then hit7. These data closely mimicked the observations in the yeast assay.

The activity ranking established on plasmid DNA was conserved when genomic DNA cleavage was monitored. At 23° C., B65 maintained significant activity, cleaving 69% of its genomic substrate (FIG. 7A). At 28° C., no cleavage activity was detected for LIG3-4 while B65, hit15 and hit7 obtained 94%, 33% and 24% cleavage, respectively (FIG. 7B). At 37° C., LIG3-4 exhibited 47% cleavage at the LIG3-4 genomic recognition site while B65, hit15 and hit7 achieved 99%, 92% and 76% cleavage, respectively (FIG. 7C). Again, the data from in vitro cutting of maize genomic DNA were consistent with observations in the yeast assay.

Example 9

Analysis of Meganuclease Activity of LIG3-4 Variants in Maize

LIG3-4 variants were created as described in Example 3 and introduced in maize by particle gun transformation and *Agrobacterium*-mediated transformation.

Three LIG3-4 variants, LIG3-4 (B65) (SEQ ID NO:27), LIG3-4(15) (SEQ ID NOs:15) and LIG3-4(7) (SEQ ID NO:14) showed an increased meganuclease activity in yeast (Example 3) and an increased activity in the in vitro assay (Example 8, FIGS. 6A-6C; FIGS. 7A-7C) and were further tested in-vivo for their activity in maize.

A. Vector Construction for Plant Expression Vectors of the Meganuclease Genes and Repair (donor) DNAs for Transgene Integration by Homologous Recombination Genes encoding the meganucleases were codon optimized for expression in maize using standard molecular biology techniques. The resulting plant-optimized nucleotide sequences were also supplemented with DNA sequences encoding a SV40 nuclear localization signal (SEQ ID NO: 72) and further modified by addition of the potato ST-LS1 intron to the coding sequence of the first monomer in order to eliminate its expression in *E. coli* and *Agrobacterium*. The resulting LIG3-4 variants, LIG3-4(7) (SEQ ID NO: 73), LIG3-4(15) (SEQ ID NO:74) and LIG3-4 (B65) (SEQ ID NO:75) were further tested for their activity in maize (in vivo).

Vectors comprising expression cassettes for the appropriate meganuclease were constructed using standard molecular biological techniques. For each of the meganucleases, a plant expression vector comprising a polynucleotide encoding one of the meganuclease genes was operably linked to a maize constitutive promoter.

To achieve site-specific DNA insertions, a repair DNA (donor DNA) containing the gene of interest has to be simultaneously present in the cell in addition to the recognition site and the meganuclease. A vector PHP46961 (SEQ ID NO: 76) containing a polynucleotide encoding the engineered meganuclease variant LIG3-4(15), and a donor DNA were constructed using standard molecular biology techniques. Similar vectors PHP46949 or PHP47257 were constructed containing the LIG3-4B(65) or LIG3-4(17), meganuclease respectively. The donor DNA contained an herbicide resistance gene (MoPAT, encoding a phosphinothricin acetyltransferase), used as the selection marker for transformation, and was flanked by two homologous recombination fragments, LIG3-4HR1 (SEQ ID NO: 77) and LIG3-4HR2 (SEQ ID NO: 78), which were about 1 kb long genomic DNA sequences flanking the meganuclease recognition sites. A vector containing LIG3-4 (PHP43914, produced as described for PHP46961) was also included as control.

The LIG3-4 variants' expression cassettes were also co-integrated into LBA4404 for *Agrobacteria* delivery. Vector names were PHP47331 for LIG3-4(B65), PHP47332 for LIG3-4 (15) and PHP47517 for LIG3-4(7), respectively.

Maize immature embryos 9-12 DAP (days after pollination, approximately 1.5-2.0 mm in size) from a maize transformable line were used for gene transformation by bombardment (Example 1 and Example 2). The immature embryos were placed on 560Y medium for 4 hours at 26° C. or alternatively, immature embryos were incubated at temperatures ranging from 26° C. to 37° C. for 8 to 24 hours prior to placing on 560Y preceding bombardment. Developmental genes ODP2 (AP2 domain transcription factor ODP2 (Ovule development protein 2); US20090328252 A1) and Wushel were included in the experiments through co-bombardment (Example 2). Maize immature embryos were transformed with the vectors PHP43914, PHP46949, PHP46961, and PHP47257.

Maize immature embryos 9-12 DAP (days after pollination, approximately 1.5-2.0 mm in size) from a maize transformable line were used for gene transformation by *Agrobacterium*. No developmental genes ODP2 or Wushel were included in the infection. Maize immature embryos were transformed with vectors of PHP47731, PHP47732, and PHP47517.

B. Meganuclease Activity of LIG3-4 Variants in Maize

To examine whether the LIG3-4 variants showed increased meganuclease activity in maize when compared to LIG3-4 about 2000 maize immature embryos were bombarded with plasmid DNA comprising each variant or control. Following bombardment, embryos were incubated on 560P (maintenance medium) at 28° C., then selected on bialophos herbicide. Successful delivery of LIG3-4 and the LIG3-4 variant donor vectors (PHP43914, PHP46949, PHP46961, and PHP47257) conferred bialaphos herbicide resistance, and was used to identify putative events by callus selection on herbicide containing media. Callus tissues and/or plants regenerated from stable transformants were screened for modification of the endogenous LIG3-4 recognition site.

Herbicide-resistant events were screened for modification at the meganuclease target site (comprising the recognition site) by measuring the target site copy-number using Real time PCR (qPCR). Two copies of the target site indicate that both alleles are wild type and that no modification occurred at the recognition site. If only one copy of the target site is detected by qPCR, this means that one allele of the target site has changed during repair of the double strand break generated by the LIG3-4 or its shuffle variants, while absence of the target site (null or 0) is the result of both alleles bring modified. The copy number can also be in between 1 and 2 due to chimeric nature of callus samples. The probe sequence for qPCR of LIG3-4 target site was ATACCTCA-CACGTACGCG (SEQ ID NO: 79), the LIG3-4_forward primer was GATTTACGCACCTGCTGGGA (SEQ ID NO: 80) and LIG3-4_reverse primer was CTGAGCTGTATTC-CCGCGCA (SEQ ID NO:81) The amplicon was approximately 100 bp.

Transgenic events with a target site copy number of 0, 1, or between 1 and 2 were further analyzed for increased meganuclease activity. The meganuclease activity was determined by measuring the Target Site (TS) mutation rate. Target site mutation rate was defined as: (number of events with target site modification/total number events)*100%. The TS mutation rate for the LIG3-4 meganuclease was 6% (Table 4). The Event Recovery Rate (Table 4) is calculated using number of events recovered divided by total number of embryos bombarded, and may indicate if a meganuclease has some toxic effect or not. Table 4 shows the effect of different LIG3-4 variants after bombardment and 6-8 weeks antibiotic selection. The meganuclease variants LIG3-4 (7) and LIG3-4 (15) both yielded significantly higher mutation frequencies when compared to the parental LIG3-4 meganuclease, consistent with observations in the yeast assay and in vitro DNA cutting assays. LIG3-4(B65) also yielded higher mutation frequency than the parental LIG3-4, but not as high as the other LIG3-4 variants. This may be due to toxicity associated with this very active meganuclease as indicated by the event recovery rate of LIG3-4 (65).

TABLE 4

Activity of LIG3-4 and LIG3-4 variant meganucleases as determined by target site mutation rate (TS mutation rate) in plant tissue originated through gene bombardment transformation.

| Meganuclease | Event Recovery Rate | TS Mutation Rate | Insertion |
|---|---|---|---|
| LIG3-4 | 17% | 6% | Yes |
| LIG3-4(7) | 13% | 29% | Yes |
| LIG3-4(15) | 15% | 54% | Yes |
| LIG3-4(B65) | 3% | 21% | Yes |

TABLE 5

Activity of LIG3-4 and LIG3-4 variant meganucleases as determined by target site mutation rate (TS mutation rate) in plant tissue originated through Agrobacterium transformation.

| Meganuclease | Event Recovery Rate | Mutation Rate | Insertion |
|---|---|---|---|
| LIG3-4 | ~20% | 1-3% | No |
| LIG3-4 (7) | 19% | 15% | Yes |
| LIG3-4 (15) | 11% | 34% | Yes |
| LIG3-4 (B65) | 9% | 74% | Yes |

Table 5 indicates that all three variant meganucleases (LIG3-4 (7), LIG3-4(15) and LIG3-4(B65) showed an increased meganuclease activity (TS mutation rate of 15%, 34% and 74%, respectively) when compared to the control non variant LIG3-4 (TS mutation rate 1 to 3%). The highest increase in meganuclease activity was observed when plant tissue was generated through Agrobacterium transformation (Table 5). These data are very consistent with data obtained in the yeast and in vitro cutting assays with these variants.

When the meganuclease and gene delivery constructs were introduced via Agrobacterium-mediated transformation, there was a much smaller reduction in the recovery of transgenic events (higher event recovery rate in Table 5 when compared to Table 4). This may be due to the fact that less DNA is delivered to the nuclei of the plant cells by this method.

Maize calli were also screened for integration of the transgene cassette from the donor DNA (PHP43914, PHP46949, PHP46961, PHP47257; agro of PHP47331, PHP47332, and PHP47517) at the LIG3-4 recognition site through junction PCR and selected callus events were regenerated into T0 plants (FIG. 8A-FIG. 8B). When integration occurred, e.g. the donor sequence was integrated at the recognition site, Insertion is designated as "Yes". When no integration occurred, Insertion is designated as "no" (Table 4 and 5). Targeting of transgenes to the LIG3-4 locus was observed with each LIG3-4 variant delivered by particle bombardment (Table 4. When introduced via Agrobacterium-mediated transformation, each LIG34 variant enabled transgene integration at the target site, whereas the parental LIG34 did not (Insertion YES for variants, NO for LIG3-4; Table 5).

Example 10

Creation of MHP77 and MHP77.3 Variant Meganucleases

A. MHP77 & MHP77.3 Meganucleases and MHP 77 Recognition Site

An endogenous maize genomic target site comprising the MHP77 recognition site (SEQ ID NO: 85) was selected for design of a custom double-strand break inducing agent. The MHP77 recognition site is a 22 bp polynucleotide located on chromosome 1 and having the following sequence:

(SEQ ID NO: 85)
GGGCGGTATGTATGTCATACTA

Wild type I-CreI meganuclease (SEQ ID NO: 3) was modified to produce two engineered meganucleases, MHP77 (SEQ ID NO: 86) and MHP77.3 (SEQ ID NO: 250), designed to recognize the MHP77 recognition sequence. The design of custom made meganucleases has been described in United States Patent Application Publication No. US 2007/0117128 A1.

B. MHP77 and MHP77.3 Variant Meganucleases

Variants of the MHP77 meganuclease were created through gene shuffling methods in a manner similar to how the LIG3-4 variants were created and described in Example 3. This involved the introduction of amino acid modifications as found in naturally occurring meganuclease proteins and previously identified in LIG3-4 variants as well as random mutations. The shuffling process resulted in generation of MHP77 variants with recombination of amino acid modifications, unintended amino acid modifications due to mutagenic PCR, deletions, and insertions (SEQ ID NOs: 86-167)

Three variants of the MHP77.3 meganuclease were created by incorporating the same amino acid modifications (mutations) of MHP77(L9-02), MHP77(L9-11), or MHP77 (L9-12), thus creating MHP77.3 (L9-02) (SEQ ID NO:251), MHP77.3 (L9-11) (SEQ ID NO:252), and MHP77.3(L9-12) (SEQ ID NO:253). MHP77.3 (15) (SEQ ID NO:262) contained the exact same nucleotide/amino acid modifications as described for LIG3-4 (15). The amino acid modifications were introduced into MHP77.3 through standard molecular biology techniques.

C. MHP77 Variant Meganucleases Activity in Yeast

A total of 79 MHP77 variants with increased activity were confirmed in the yeast system (as described in Example 6). Increased activity was observed across a range of temperatures: 24° C., 28° C., 30° C. and 37 37° C., as shown in Table 6. A score of 0 indicates that no white sectors (no cutting indicating no meganuclease activity) were observed; a score of 4 indicates completely white colonies (complete cutting of the recognition site indicating high meganuclease activity); scores of 1-3 indicate intermediate white sectoring phenotypes (and intermediate degrees of recognition site cutting) was indicative of intermediate meganuclease activity.

TABLE 6

Activity of MHP77 variant Meganucleases in Yeast Screening Strain assayed at different temperatures.

| #Variant | 24° C. | 28° C. | 30° C. | 37° C. |
|---|---|---|---|---|
| MHP77 | 0 | 0 | 0 | 0 |
| MHP77(L15-31) | X | 4 | 4 | 4 |
| MHP77(L16-11) | 4 | 4 | 4 | 4 |
| MHP77(L16-09) | 2.5 | 4 | 4 | 4 |
| MHP77(L16-04) | 2 | 4 | 4 | 4 |
| MHP77(L16-19) | 2 | 4 | 4 | 4 |
| MHP77(L16-17) | 3 | 3.5 | 4 | 4 |
| MHP77(L16-23) | 1 | 3.5 | 4 | 4 |
| MHP77(L15-34) | 1 | 3.5 | 4 | 4 |
| MHP77(L15-40) | 0.5 | 3.5 | 4 | 4 |
| MHP77(L15-39) | 0.5 | 3.5 | 4 | 4 |
| MHP77(L15-45) | 0.5 | 3 | 4 | 4 |
| MHP77(L15-29) | 0.5 | 2.5 | 4 | 4 |
| MHP77(L15-06) | 0 | 2 | 4 | 4 |
| MHP77(L16-08) | 1 | 3 | 3.5 | 4 |
| MHP77(L16-05) | 1 | 3 | 3.5 | 4 |
| MHP77(L16-02) | 0.5 | 2.5 | 3.5 | 4 |
| MHP77(L16-24) | 0 | 2.5 | 3.5 | 4 |
| MHP77(L16-21) | 0 | 2.5 | 3.5 | 4 |
| MHP77(L16-14) | 0 | 2.5 | 3.5 | 4 |
| MHP77(L16-18) | 0.5 | 2 | 3.5 | 4 |
| MHP77(L15-27) | 0 | 2 | 3.5 | 4 |
| MHP77(L9-02) | 0 | 2 | 3 | 4 |
| MHP77(L16-12) | 0 | 2 | 3 | 4 |
| MHP77(L16-01) | 0 | 2 | 3 | 4 |
| MHP77(L15-05) | 0 | 2 | 3 | 4 |
| MHP77(L15-24) | 0 | 2 | 3 | 4 |
| MHP77(L16-06) | 0 | 1 | 3 | 4 |
| MHP77(L16-15) | 0 | 1 | 3 | 4 |
| MHP77(L15-33) | 0 | 1 | 3 | 4 |
| MHP77(L16-03) | 0 | 2 | 2.5 | 4 |
| MHP77(L15-47) | 0 | 0 | 2.5 | 4 |
| MHP77(L15-46) | 0 | 0 | 2.5 | 4 |
| MHP77(L9-12) | 0 | 1 | 2 | 4 |
| MHP77(L16-16) | 0 | 1 | 2 | 4 |
| MHP77(L15-10) | 0 | 1 | 2 | 4 |
| MHP77(L9-03) | 0 | 0.5 | 2 | 4 |
| MHP77(L15-20) | 0 | 0.5 | 2 | 4 |
| MHP77(L15-28) | 0 | 0 | 2 | 4 |
| MHP77(L15-21) | 0 | 0 | 2 | 4 |
| MHP77(L15-13) | 0 | 0 | 2 | 4 |
| MHP77(L9-04) | 0 | 0 | 1 | 4 |
| MHP77(L15-18) | 0 | 0 | 1 | 4 |
| MHP77(L18-01) | X | 0 | 0 | 4 |
| MHP77(L17-12) | X | 0 | 0 | 4 |
| MHP77(L17-01) | X | 0 | 0 | 4 |
| MHP77(L15-03) | 0 | 0.5 | 2 | 3.5 |
| MHP77(L15-11) | 0 | 0.5 | 1 | 3.5 |
| MHP77(L18-12) | X | 0 | 1 | 3.5 |
| MHP77(L15-15) | 0 | 0 | 1 | 3.5 |
| MHP77(L15-12) | 0 | 0 | 1 | 3.5 |
| MHP77(L9-1)* | 0 | 1 | 2 | 3 |
| MHP77(L9-9) | 0 | 0 | 1 | 3 |
| MHP77(L9-11) | 0 | 0 | 1 | 3 |
| MHP77(L9-10) | 0 | 0 | 1 | 3 |
| MHP77(L15-02) | 0 | 0 | 1 | 3 |
| MHP77(L15-08) | 0 | 0 | 0.5 | 3 |
| MHP77(L16-07) | 0 | 0 | 0 | 3 |
| MHP77(L15-35) | 0 | 0 | 0 | 2.5 |
| MHP77(L13-12) | 0 | 0 | 0 | 2.5 |
| MHP77(L113-01) | 0 | 0 | 0 | 2.5 |
| MHP77(L9-06) | 0 | 0.5 | 0.5 | 2 |
| MHP77(L15-42) | 0 | 0 | 0 | 2 |
| MHP77(L15-41) | 0 | 0 | 0 | 2 |
| MHP77(L15-36) | 0 | 0 | 0 | 2 |
| MHP77(L15-30) | 0 | 0 | 0 | 2 |
| MHP77(L112-03a) | 0 | 0 | 0 | 2 |
| MHP77(L73-02a) | 0 | 0 | 0 | 1.5 |
| MHP77(L13-10B1) | 0 | 0 | 0 | 1.5 |
| MHP77(L72-08a) | X | 0 | 0 | 1 |
| MHP77(L72-09a) | 0 | 0 | 0 | 1 |
| MHP77(L72-01a) | 0 | 0 | 0 | 1 |
| MHP77(L13-08a) | 0 | 0 | 0 | 1 |
| MHP77(L13-06) | 0 | 0 | 0 | 1 |
| MHP77(L13-02) | 0 | 0 | 0 | 1 |
| MHP77(L13-01a) | 0 | 0 | 0 | 1 |
| MHP77(L73-05a) | 0 | 0 | 0 | 0.5 |
| MHP77(L15-43) | 0 | 0 | 0 | 0.5 |
| MHP77(L13-04) | 0 | 0 | 0 | 0.5 |
| MHP77(L13-11) | 0 | 0 | 0 | 0.5 |
| MHP77(L15-23) | 0 | 0 | 0 | 0 |
| MHP77(L15-16) | 0 | 0 | 0 | 0 |

Large increases in meganuclease activity (high scores) were observed. Complete cutting of the recognition site was observed with some variants even at the temperature of 22° C. (see MHP77(L16-11) Table 6).

FIG. 9A-FIG. 9N show the amino acid modifications of MHP77 variants relative to the MHP77 parental meganuclease. A (−) indicates that the amino acid is identical to the MHP77 reference sequence.

Example 11

Analysis of MHP77 and MHP77.3 Meganuclease Variants in Maize

Genes encoding the MHP77 and MHP77.3 engineered meganucleases (Example 10) were optimized for expression in plants. The engineered meganuclease expression cassettes contained the maize codon-optimized nucleotide sequences for better performance in maize cells. The meganuclease gene sequences were also supplemented with DNA sequences encoding a SV40 nuclear localization signal resulting in the plant optimized sequence of SEQ ID NO: 254 for MHP77 and SEQ ID NO:255 for MHP77.3. The maize ubiquitin promoter and the potato proteinase inhibitor II gene terminator sequences completed the endonuclease gene designs.

The plant optimized nucleotide sequence for the MHP77 and MHP77.3 variants were MHP77(L9-02) (SEQ ID NO:256), MHP77(L9-11) (SEQ ID NO:257), MHP77(L9-12) (SEQ ID NO:258), MHP77.3 (L9-02) (SEQ ID NO:259, MHP77.3 (L9-11) (SEQ ID NO:260), and MHP77.3(L9-12) (SEQ ID NO:261) and MHP77(15) (SEQ ID NO:263).

A. Vector Construction for Plant Expression Vectors of the Meganuclease Genes and Repair (Donor) DNAs for Transgene Integration by Homologous Recombination Vectors comprising expression cassettes for the appropriate meganuclease were constructed using standard molecular biological techniques. For each of the meganucleases, a plant expression vector comprising a polynucleotide encoding one of the meganuclease genes was operably linked to a maize constitutive promoter.

To achieve site-specific DNA insertions, a repair DNA (donor DNA) containing the gene of interest has to be simultaneously present in the cell in addition to the recognition site and the meganuclease. Vectors similar to PHP46961 (SEQ ID NO:76) described in Example 9, but containing a polynucleotide encoding the meganuclease variant MHP77(L9-11), MHP77(L9-12), MHP77(L9-02), MHP77.3(L9-11), MHP77.3(L9-12), MHP77.3(L9-02), or MHP77.3(15); and a donor DNA were constructed using standard molecular biology techniques. These vectors were referred to as PHP53132, PHP53134, PHP53136, PHP53133, PHP53135, PHP53137 and PHP50239. The donor DNA contained an herbicide resistance gene used as the selection marker for transformation. The herbicide resistance gene MoPAT encodes a phosphinothricin acetyltransferase, and was flanked by two homologous recombination fragments, MHP77HR1 (SEQ ID NO:264) and MHP77HR2 (SEQ ID NO: 265), which were about 1 kb long genomic DNA sequences flanking the meganuclease recognition sites.

Maize immature embryos 9-12 DAP (days after pollination, approximately 1.5-2.0 mm in size) from a maize transformable line were used for gene transformation by bombardment (Example 1 and Example 2). The immature embryos were placed on 560Y medium for 4 hours at 26° C. or alternatively, immature embryos were incubated at temperatures ranging from 26° C. to 37° C. for 8 to 24 hours prior to placing on 560Y preceding bombardment. Developmental genes ODP2 (AP2 domain transcription factor ODP2 (Ovule development protein 2); US20090328252 A1) and Wushel were included in the experiments through co-bombardment (Example 2). Maize immature embryos were transformed with the vectors PHP53132, PHP53134, PHP53136, PHP53133, PHP53135, PHP53137, and PHP50239.

B. Meganuclease Activity of MHP77 and MHP77.3 Variants in Maize

To examine whether the MHP77 and MHP77.3 meganuclease variants increased meganuclease activity when compared to MHP77 or MHP77.3, about 2000 maize immature embryos were bombarded with plasmid DNA of each variant and control. Following bombardment, embryos were incubated on 560P (maintenance medium) at 28° C., then selected on Herbicide (bialophos). Successful delivery of the MHP77, MHP77.3 variants donor vectors (PHP45970, PHP50238, PHP53132, PHP53134, PHP53136, PHP53133, PHP53135, PHP53137, or PHP50239) conferred bialaphos herbicide resistance, and was used to identify putative events by callus selection on herbicide containing media. Callus tissues and/or plants regenerated from stable transformants using standard culture and regeneration conditions were screened for modification of the endogenous MHP77 recognition site.

Herbicide-resistant events were screened for modification at the target site (comprising the MHP77 recognition site) by measuring target site copy-number using qPCR as described in Example 9. The probe sequence for qPCR of MHP77 target site was ACTAATTCAAGTGATGGACAAA (SEQ ID NO: 266), the MHP77 forward primer was TCCTTAGGGCGGTATGTATGTCA (SEQ ID NO: 267) and MHP77 reverse primer was CATCGGTCAAAAAACACATAAACTTT (SEQ ID NO: 268). The amplicon was approximately 100 bp.

Target site mutation rate (TS mutation rate, Table 7) indirectly measures the meganuclease activity. Table 7 shows the effect of different shuffle variants of MHP77 and shuffle meganuclease after bombardment and 6-8 weeks antibiotic selection. Table 7 indicates that all the three shuffled variants of MHP77 meganucleases are more active when compared to MHP77 meganuclease. Increased activity of shuffled MHP77 meganuclease also resulted in a reduction of the event recovery when compared to the MHP77 (control).

TABLE 7

Activity of MHP77 and MHP77 variant meganucleases as determined by target site mutation rate (TS mutation rate) in plant tissue originated through gene bombardment transformation.

| Meganuclease | Event Recovery Rate | TS Mutation Rate | Insertion |
|---|---|---|---|
| MHP77 (control) | 21% | 1% | no |
| MHP77L9-11 | 11% | 4% | no |
| MHP77L9-12 | 9% | 17% | yes |
| MHP77L9-02 | 3% | 6% | no |

TABLE 8

Activity of MHP77.3 and MHP77.3 variant meganucleases as determined by target site mutation rate (TS mutation rate) in plant tissue originated through *Agrobacterium* transformation.

| Meganuclease | Transformation rate | Mutation Rate | Insertion |
|---|---|---|---|
| MHP77.3 | 14% | 11% | no |
| MHP77.3(15) | 13% | 22% | yes |
| MHP77.3L9-11 | 9% | 35% | yes |
| MHP77.3L9-12 | 3% | 19% | yes |
| MHP77.3L9-02 | 2% | 5% | no |

Table 8 indicates that all the four shuffled variants of MHP77.3 meganucleases are more active when compared to the non variant MHP77.3 meganuclease. Increased activity of some but not all shuffled MHP77 meganuclease resulted in a reduction of the event recovery when compared to the MHP77.

Maize calli were also screened for integration of the transgene cassette from the donor DNA vector (PHP45970, PHP50238, PHP53132, PHP53134, PHP53136, PHP53133, PHP53135, PHP53137, and PHP50239) at the MHP77 recognition site through junction PCR and selected callus events were regenerated into T0 plants. When integration occurred, e.g. the donor sequence was integrated at the recognition site. Insertion (Table 7 and 8) is designated as "Yes". When no integration occurred, Insertion is designated as "no".

Example 12

Creation of MS26 Variant Meganucleases

A. MS26+ & MS26++ Meganucleases and MS26 Recognition Site

An endogenous maize genomic target site comprising the MS26 recognition site (SEQ ID NO: 269) was selected for design of a custom double-strand break inducing agent. The MHP26 recognition site is a 22 bp polynucleotide and having the following sequence:

(SEQ ID NO: 269)
gatggtgacgtacgtgccctac

Wild type I-CreI meganuclease (SEQ ID NO: 3) was modified to produce two engineered meganucleases, MHP26+ (SEQ ID NO: 270) and MHP26++ (SEQ ID NO: 271), designed to recognize the MHP26 recognition sequence. The design of custom made meganucleases has been described in United States Patent Application Publication No. US 2007/0117128 A1.

B. MS26 Variant Meganucleases

As described in Example 6 and 9, LIG3-4 variants were introduced into yeast and maize and demonstrated significantly higher meganuclease activity when compared to the non-variant LIG3-4 meganuclease. These LIG3-4 variants were characterized with specific amino acid modifications when compared to the parental LIG3-4 (Table 2 and FIG. 5A-5E). To test if these amino acid modification (and respective nucleotide modifications) can also increase the activity of a MS26+ meganuclease, the exact same nucleotide/amino acid modifications as described for LIG3-4 (7), LIG3-4 (15), and Lig3-4(B65) were introduced into MS26+ through standard molecular biology techniques, resulting in the following three MS26+ variants: MS26+ (7) (SEQ ID NO: 272), MS26+ (15) (SEQ ID NO:273), and MS26 (B65) (SEQ ID NO: 274) variants.

Similarly, the MS26++ nucleotide/amino acid sequence was optimized to include the nucleotide/amino acid modifications of LIG3-4 (15) resulting in MS26++(15) meganuclease variant (SEQ ID NO: 275).

Example 13

Analysis of Meganuclease Activity of MS26+ and MS26++ Variants in Maize

Genes encoding the MHP26+ and MHP26++ engineered meganucleases were optimized for expression in plants. The engineered meganuclease expression cassettes contained the maize codon-optimized nucleotide sequences for better performance in maize cells. The meganuclease gene sequences were also supplemented with DNA sequences encoding a SV40 nuclear localization signal (SEQ ID NO: 34) resulting in the plant optimized sequence of SEQ ID NO: 276 for MHP26+ and SEQ ID NO:279 for MS26++. The maize ubiquitin promoter and the potato proteinase inhibitor II gene terminator sequences completed the endonuclease gene designs. Plant optimized sequences for MS26+ and MS26++ variant meganucleases are SEQ ID NO: 419, 277-279 and SEQ ID NO:280, respectively.

A. Vector Construction for Plant Expression Vectors of the Meganuclease Genes and Repair (Donor) DNAs for Transgene Integration by Homologous Recombination Coding parts of the MS26+ variants were introduced into the test vector PHP51583 containing a slot for meganuclease driven by ubiquitin promoter, a fusion of two marker genes, MoPAT and DsRed, also under the control of ubiquitin promoter, and kanamicyn resistance gene.

The resulting constructs were delivered into the scutellum cells of maize immature embryos via microprojectile bombardment as described in Example 1. Developmental genes (BBM and WUS) were also delivered by co-bombarded (Example 1 and 2).

B. Meganuclease Activity of MS26+ Variants in Maize

Callus tissue of transgenic events was collected, total genomic DNA was extracted and used as a template to amplify DNA fragment of about 1 kb comprising the Ms26 recognition site. Frequencies of mutations of the MS26 recognition site (Target site mutation rate) were estimated by the fragments digestion with BsiWI restriction nuclease which cuts the intended Ms26 recognition site. Frequency of mutations was calculated based on the percentage of remaining (uncut) fragment indicating mutations at the target site. Events with at least 50% of undigested fragment were indicative of at least one allel being cut in first stages of development and thus were indicative of mutations. Unlike in the case of LIG3-4 (Example 9), no decrease in frequency of event recovery of the MS26+ variants was observed when compared to the parental MS26+. All three MS26+ variants yielded higher mutation frequencies compared with Ms26+ meganuclease (Table 9). While Ms26+(B65) and Ms26+(7) demonstrated moderate increase in meganuclease activity (3 and 4 fold increase, respectively), Ms26+(15) demonstrated approximately a 10 fold increase of activity (Table 9).

TABLE 9

Activity of MS26+ and MS26+ variant meganucleases as determined by target site mutation rate (TS mutation rate) in plant tissue.

| Meganuclease | Number of events analyzed | TS Mutation Rate |
|---|---|---|
| MS26+ | 282 | 2% |
| MS26+ (7) | 191 | 9% |
| MS26+ (15) | 227 | 25% |
| MS26+ (B65) | 176 | 7% |

Introducing the same amino acid modifications (mutations) as LIG3-4 (15) into MS26++ (15) resulted in a dramatic increase of meganuclease activity as measured by the % mutation rate of MS26++ (44%) when compared to MS26 (7%) (Table 10). This data indicates that nearly half of all events analyzed carried mutations at the Ms26 recognition site.

TABLE 10

Activity of MS26+ and MS26+ variant meganucleases as determined by target site mutation rate (TS mutation rate) in plant tissue.

| Meganuclease | Number of events analyzed | TS Mutation Rate |
|---|---|---|
| MS26++ | 189 | 7% |
| MS26+ (15) | 185 | 44% |

Example 14

Creation of MHP and MHP14+ Variant Meganucleases

A. MHP14 & MHP14+ Meganucleases and MHP14 Recognition Site

An endogenous maize genomic target site comprising the MHP14 recognition site (SEQ ID NO: 281) was selected for design of a custom double-strand break inducing agent. The MHP14 recognition site is a 22 bp polynucleotide located and having the following sequence:

```
                                        (SEQ ID NO: 281)
        caaacagattcacgtcagattt
```

Wild type I-CreI meganuclease was modified to produce the engineered meganucleases MHP14 (SEQ ID NO: 282) and MHP14+ (SEQ ID NO: 283) designed to recognize the MHP14 recognition sequence. The design of custom made meganucleases has been described in United States Patent Application Publication No. US 2007/0117128 A1.

B. MHP14 and MHP14+ Variant Meganucleases

Variants of the MHP14 meganuclease were created through gene shuffling methods in a manner similar to how the LIG3-4 variants were created and described in Example 3. This involved the introduction of amino acid modifications as found in naturally occurring meganuclease proteins and previously identified in LIG3-4 variants as well as random mutation. The shuffling process resulted in generation of MHP14 variants with recombination of amino acid modifications, unintended amino acid modifications due to mutagenic PCR, deletions, and insertions (SEQ ID NOs: 284-298) Corresponding DNA sequences are SEQ ID NO:300-314.

Mutations from five MHP14 variants, MHP14 (04), MHP14 (06), MHP14 (08), MHP14 (12) and MHP14 (14), were introduced into MHP14+, resulting in MHP14+(04) (SEQ ID NO: 315), MHP14+(06) (SEQ ID NO: 316), MHP14+(08) (SEQ ID NO: 317), MHP14+(12) (SEQ ID NO: 318), MHP14+(14) (SEQ ID NO: 319), respectively. One additional variant was generated by introduction of the G19S mutation from LIG3-4 (15) into MHP14+, resulting in MHP14+(15) (SEQ ID NO: 320). These mutations were introduced into MHP14+ through standard molecular biology techniques.

Example 15

Analysis of Meganuclease Activity of MHP14 and MHP14+ Variants in Yeast and Maize A total of 15 MHP14 variants with increased activity were confirmed in the yeast system (as described in Example 6). Increased activity was observed across a range of temperatures: 28 degrees Celsius, 34 degrees Celsius and 37 degrees Celsius, as shown in Table 11.

TABLE 11

Activity of MHP14 variant meganucleases in yeast Screening Strain assayed at different temperatures.

| meganuclease | 28° C. | 34° C. | 37° C. |
| --- | --- | --- | --- |
| MHP14 | 0 | 2 | 2 |
| MHP14(L14-07) | 0.5 | | 4 |
| MHP14(01) | 0 | 3 | 3 |
| MHP14(06) | 0 | 3.5 | 3.5 |
| MHP14(L14-04) | 0 | | 3 |
| MHP14(08) | 1 | 4 | 4 |
| MHP14(07) | 0.5 | 2.5 | 2.5 |
| MHP14(03) | 0.5 | 3 | 3 |
| MHP14(04) | 2 | x | x |
| MHP14(02) | 2 | 4 | 4 |
| MHP14(13) | 1 | 4 | 3.5 |
| MHP14(L14-03) | 0 | | 3 |
| MHP14(14) | 1 | 4 | 4 |
| MHP14(09) | 2 | 4 | 4 |

TABLE 11-continued

Activity of MHP14 variant meganucleases in yeast Screening Strain assayed at different temperatures.

| meganuclease | 28° C. | 34° C. | 37° C. |
| --- | --- | --- | --- |
| MHP14(12) | 1.5 | 4 | 4 |
| MHP14(10) | 1 | 4 | 4 |

Large increases in meganucleaseactivity (high scores) were observed.

FIG. 10A-FIG. 10D show the amino acid modifications of MHP14 variant meganucleases relative to the MHP14 parental meganuclease. A (−) indicates that the amino acid is identical to MHP14.

Results from activity screening of five MHP14+ variants are shown in Table 12.

TABLE 12

Activity of MHP14+ variant meganucleases in yeast Screening Strain assayed at different temperatures.

| Meganuclease | 28° C. | 37° C. |
| --- | --- | --- |
| MHP14 | 0 | 2 |
| MHP14+ (04) | 2 | X |
| MHP14+ (06) | 0 | 4 |
| MHP14+ (08) | 1 | 4 |
| MHP14+ (12) | 2 | 4 |
| MHP14+ (14) | 1 | 4 |
| MHP14+ (15) | — | — |

All MHP14+ variants showed higher activity in the Yeast Assay screened at 37 C when compared to the MHP14 meganuclease (Table 12). Variant MHP14+(04), MHP14+ (08), MHP14+ (12) and MHP14+ (14) showed increased activity even when assayed at lower temperatures temperature of 28° C. (Table 12.)

Genes encoding the MHP14 and MHP14+ variant meganucleases were optimized for expression in plants. The engineered meganuclease expression cassettes contained the maize codon-optimized nucleotide sequences for better performance in maize cells. The meganuclease gene sequences were also supplemented with DNA sequences encoding a SV40 nuclear localization resulting in the plant optimized sequences of SEQ ID NOs: 321-327. The maize ubiquitin promoter and the potato proteinase inhibitor II gene terminator sequences completed the endonuclease gene designs.

Testing and analysis of meganuclease activity of the MHP14+ variants in-planta was performed as described for Ms26+ and Ms26++ variants (Example 12) and results are shown in Table 13.

TABLE 13

Activity of MHP14 and MHP14+ variant meganucleases in maize as determined by target site mutation rate (TS mutation rate) in plant tissue.

| Meganuclease | Number of events analyzed | TS Mutation Rate |
| --- | --- | --- |
| MHP14 | 192 | 13% |
| MHP14+ (04) | 192 | 38% |
| MHP14+ (06) | 192 | 7% |
| MHP14+ (08) | 192 | 25% |
| MHP14+ (12) | 192 | 47% |
| MHP14+ (14) | 192 | 39% |
| MHP14+ (15) | 192 | 20% |

Two variants, MHP14+ (04) and MHP14+ (08), while demonstrating higher activity also showed rather high levels of toxicity. MHP14+06 showed no difference in both toxicity and activity when compared to MHP14. Two variants, MHP14+ (12) and MHP14+ (14), demonstrated high levels of activity without increased toxicity. MHP14+ (15) variant showed moderate increase of activity and no increase of toxicity (Table 13).

Example 16

DNA Shuffling to Create Variants of MP107 Meganuclease

An endogenous maize genomic target site comprising the MP107 recognition sequence (SEQ ID NO:328) was selected for design of a custom double-strand break inducing agent. The MP107 recognition site is a 22 bp polynucleotide having the following sequence:

```
                                    (SEQ ID NO: 328)
        ctagtatacgtgagagaccttg.
```

An engineered MP107 meganuclease (SEQ ID NO: 329) was produced as described in Example 3.

The first phase of MP107 meganuclease optimization was designed to introduce amino acid modifications into the MP107 meganuclease as described in Example 3. Libraries were based on introduction of mutations previously identified in LIG3-4, MHP14 and MHP77 variants with increased activity.

The shuffling process resulted in generation of variants with recombination of amino acid modifications, unintended amino acid modifications due to mutagenic PCR, deletions, and insertions (SEQ ID NOs: 330-341). Corresponding nucleotide sequences are shown in SEQ ID NOs:343-354.

A total of 6 MHP107 variants with increased activity were confirmed in the yeast system (as described in Example 6). Increased activity was observed across a range of temperatures: 28 degrees Celsius, 30 degrees Celsius and 37 degrees Celsius, as shown in Table 14.

TABLE 14

Activity of MP107 variant Meganucleases in Yeast Screening Strain assayed at different temperatures.

| meganuclease | 28° C. | 30° C. | 37° C. |
| --- | --- | --- | --- |
| MHP107 | 0 | 0 | 0 |
| MHP107(D1) | 0 | 0 | 0 |
| MHP107(D5) |  | 0.5 | 1.5 |
| MHP107(D3) |  | 0.5 | 2 |
| MHP107(D2) |  | 0 | 0 |
| MHP107(C6) | 0.5 | 1 | 3 |
| MHP107(C4) |  | 0 | 0 |
| MHP107(D4) |  | 0 | 2 |
| MHP107(C5) |  | 0 | 1 |
| MHP107(C1) | 2 | 3 | 4 |
| MHP107(C2) |  | 0 | 0 |
| MHP107(D6) | 0 | 0 | 0 |
| MHP107(C3) |  | 0 | 0 |

FIG. 11 show the amino acid modifications of MP107 variants relative to the MP107 parental meganuclease. A (−) indicates that the amino acid is identical to MP107.

Example 17

DNA Shuffling to Create Variants of Zm6.3 Meganuclease

An endogenous maize genomic target site comprising the Zm6.3 recognition sequence (SEQ ID NO:355) was selected for design of a custom double-strand break inducing agent. The Zm6.3 recognition site is a 22 bp polynucleotide having the following sequence: caggctctcgtaaatgcgcctg (SEQ ID NO:355).

An engineered Zm6.3 meganuclease (SEQ ID NO:356)) was produced as described in Example 3.

The first phase of Zm6.3 meganuclease optimization was designed to introduce amino acid modifications into the Zm6.3 meganuclease as described in Example 3. Libraries were based on introduction of mutations previously identified in LIG3-4, MHP14 and MHP77 variants with increased activity.

The shuffling process resulted in generation of variants with recombination of amino acid modifications, unintended amino acid modifications due to mutagenic PCR, deletions, and insertions (SEQ ID NOs: 357-371). Corresponding nucleotide sequences are shown in SEQ ID NOs:373-387.

A total of 15 Zm6.3 variants with increased activity were confirmed in the yeast system (as described in Example 6). Increased activity was observed across a range of temperatures: 28 degrees Celsius, 30 degrees Celsius and 37 degrees Celsius, as shown in Table 15.

TABLE 15

Activity of Zm6.3 variant Meganucleases in Yeast Screening Strain assayed at different temperatures.

| meganuclease | 28° C. | 30° C. | 37° C. |
| --- | --- | --- | --- |
| ZM6.3 | 0 | 0.5 | 2 |
| ZM6.3(4) | 1 | 2 | 4 |
| ZM6.3(3) | 0 | 0 | 2 |
| ZM6.3(5) | 0.5 | 1 | 4 |
| ZM6.3(H2) | 2 | 2 | 4 |
| ZM6.3(H3) | 2 | 2 | 4 |
| ZM6.3(1) | 1 | 1.5 | 4 |
| ZM6.3(G4) | 2 | 2.5 | 4 |
| ZM6.3(G1) | 4 | 4 | 4 |
| ZM6.3(G5) | 0 | 0 | 2 |
| ZM6.3(G2) | 2.5 | 4 | 4 |
| ZM6.3(H1) | 4 | 4 | 4 |
| ZM6.3(G6) | 4 | 4 | 4 |
| ZM6.3(G3) | 2 | 2.5 | 4 |
| ZM6.3(H6) | 4 | 4 | 4 |
| ZM6.3(H5) | 4 | 4 | 4 |

FIG. 12 shows the amino acid modifications of Zm6.3 variants relative to the Zm6.3 parental meganuclease. A (−) indicates that the amino acid is identical to Zm6.3.

Example 18

DNA Shuffling to Create Variants of Zm6.22v2 Meganuclease

An endogenous maize genomic target site comprising the Zm6.22v2 recognition sequence (SEQ ID NO:388) was selected for design of a custom double-strand break inducing agent. The Zm6.22v2 recognition site is a 22 bp polynucleotide having the following sequence: attgctctctcacatactttta (SEQ ID NO:388).

An engineered Zm6.22v2 meganuclease (SEQ ID NO:389). was produced as described in Example 3.

The first phase of Zm6.22v2 meganuclease optimization was designed to introduce amino acid modifications into the Zm6.22v2 meganuclease as described in Example 3. Libraries were based on introduction of mutations previously identified in LIG3-4, MHP14 and MHP77 variants with increased activity.

The shuffling process resulted in generation of variants with recombination of amino acid modifications, unintended amino acid modifications due to mutagenic PCR, deletions, and insertions (SEQ ID NOs: 390-403). Corresponding nucleotide sequences are shown in SEQ ID NOs:405-418.

A total of 13 ZM6.22v2 variants with increased activity were confirmed in the yeast system (as described in Example 6). Increased activity was observed across a range of temperatures: 28 degrees Celsius, 30 degrees Celsius and 37 degrees Celsius, as shown in Table 16.

TABLE 16

Activity of ZM6.22v2 variant Meganucleases in Yeast Screening Strain assayed at different temperatures.

| meganuclease | 28° C. | 30° C. | 37° C. |
| --- | --- | --- | --- |
| ZM6.22v2 | 0 | 0 | 1 |
| ZM6.22v2(I2) | 1 | 2 | x |
| ZM6.22v2(J5) | | 0.5 | 4 |
| ZM6.22v2(J8) | | 1 | 3 |
| ZM6.22v2(J3) | | 0.5 | 3 |
| ZM6.22v2(J4) | | 0.5 | 3.5 |
| ZM6.22v2(J7) | | 0.5 | 3 |
| ZM6.22v2(I6) | 0.5 | 1 | 2 |
| ZM6.22v2(I4) | 0 | 0 | 3 |
| ZM6.22v2(I3) | 0 | 0 | 2 |
| ZM6.22v2(I5) | 0 | 0 | 0 |
| ZM6.22v2(J2) | | 0 | 2 |
| ZM6.22v2(I9) | | 0 | 2 |
| ZM6.22v2(I7) | | 0 | 2 |
| ZM6.22v2(I8) | | 0.5 | 2.5 |
| ZM6.22v2 | 0 | 0 | 1 |
| ZM6.22v2(I2) | 1 | 2 | x |
| ZM6.22v2(J5) | | 0.5 | 4 |
| ZM6.22v2(J8) | | 1 | 3 |

FIG. 13 shows the amino acid modifications of Zm6.22v2 variants relative to the Zm6.22v2 parental meganuclease. A (−) indicates that the amino acid is identical to Zm6.22v2

Example 19

Use of Different Amino Acid Linkers Sequences to Create Meganucleases with Increased Activity As discussed in Example 3, all variant meganucleases comprised a linker polypeptide that links the two re-engineered I-CreI monomers into a single amino chain. The variant meganucleases MHP14(10) (SEQ ID NO:292) and MHP77(L9-01) (SEQ ID NO: 92) were created as described in Examples. These variant meganucleases were also characterized by having a different linker sequence when compared to the linker sequence in their respective parent meganucleases (FIG. 15A-FIG. 15D). In MHP14(10), a frameshift occurred at the second codon of the linker E160 and the reading frame was restored at S193, the last residue of the linker. In MHP77(L9-01), a frameshift occurred at the first codon of the linker W159 and the reading frame was restored at L198. So the first 4 amino acids of the second unit of the linked dimer were changed. These data indicates that variant meganucleases can be created with a diverse linker sequence, while still obtaining increased meganuclease activity.

Alignment of the entire amino acid sequence (FIG. 15B) of LIG3-4 (SEQ ID NO:1), MHP14 (SEQ ID NO:282) MHP14(10) (SEQ ID NO:292), MHP77 (SEQ ID NO: 86), and MHP77(L9-01) (SEQ ID NO: 92) revealed a percent identity of as low as 80.8%. Hence, variant meganucleases were created that had increased meganuclease activity while having only 80% similarity to the parental meganuclease.

Example 20

Identification of Amino Acid Modifications in Structural Motifs of Meganucleases An analysis of the physical positions of amino acid modifications responsible for increased meganuclease activity was performed using a three dimensional structure model of the I-CreI meganuclease dimer (Chevalier B S, Monnat Jr R J, Stoddard B L Nat. Struct. Biol. (2001) 8 p. 312). Amino acid modifications in alpha helix-1 positions 12, 16 and 19 were associated with increased activity observed with several meganuclease variants as shown in FIG. 16. Alpha helix-1 encompasses amino acids 8 through 19 on subunit number 1 and amino acids 195 through 206 on subunit number 2 in SEQ ID NO: 1. Additionally, amino acid modifications in alpha helix-5 positions 121, 124, 129, 131 and 132 were associated with increased activity observed in several meganuclease variants as shown in FIG. 16. Alpha helix-5 encompasses amino acids 120-135 on subunit number 1 and amino acids 307 through 322 on subunit number 2 in SEQ ID NO: 1. We predict that additional amino acid modifications in alpha helix-1 and alpha helix-5 have the potential to result in meganuclease variants with increased activity over the corresponding reference meganucleases.

Example 21

Transfer of at Least One Amino Acid Modification to Other Meganuclease to Create Variant Meganuclease with Increased Activity As described in the Example 3-19, any one of the amino acid modifications identified in Examples 3-19 can be transferred to a parental meganuclease to create a variant meganuclease with increased activity. FIG. 14A-FIG. 14F list a subset of variant I-CreI type meganucleases with increased activity. Anyone of these amino acid modifications can be combined to create a new variant with increased activity.

One embodiment of this invention is the transfer of at least amino acid modification selected from the group of Y12 to H, G19 to S or A, Q50 to K or R, F54 to I, D56 to L, V105 to A, E124 to R, V129 to A, I132 to V or T, D153 to M or L, V316 to A or I 319 to V to a parental meganuclease in order to improve the activity of the parental meganuclease.

Example 22

Saturated Mutagenesis to Create Variant Meganucleases with Increased Activity

Saturated mutagenesis can be performed at any of the amino acid modification positions described in examples 3-21. Saturated mutagenesis will result in the production a set of meganucleases wherein one amino acid position is substituted with one of all possible amino acids. This set of meganucleases can then be analyzed for increased activity as described above resulting in identifying more possible modifications for an amino acid position that will result in an increased meganuclease activity.

Example 23

Creation and Analyses of TS21 and TS14 Variant Meganucleases in Soybean

A. TS21 and TS14 Recognition Sites and Meganucleases

An endogenous soybean genomic target site comprising the TS21 recognition sequence (SEQ ID NO: 423) or the TS14 recognition sequence (SEQ ID NO: 424) was selected for design of a custom double-strand break inducing agent. The soybean genomic target sites and design of custom made TS21 and TS14 meganucleases have been described in U.S. patent application Ser. No. 13/427,138, filed on Mar. 22, 2012, which is incorporated by reference in its entirety.

B. TS21 and TS14 Variant Meganucleases

To test if the LIG3-4 amino acid modifications (and respective nucleotide modifications) can also increase the activity of the soybean TS21 meganuclease and TS14 meganuclease, the exact same nucleotide/amino acid modifications as described for LIG3-4 (7), LIG3-4 (15), and Lig3-4(B65) (Table 1A) were introduced into TS21 meganuclease (SEQ ID NOs: 425 and 429) and TS14 meganuclease (SEQ ID NOs: 433 and 435) through standard molecular biology techniques, resulting in the following three TS21 meganuclease variants and one TS14 meganuclease variant: TS21 (7) (SEQ ID NOs: 426 and 430), TS21(15) (SEQ ID NOs: 427 and 431), TS21(B65) (SEQ ID NOs: 428 and 432), and TS14(15) (SEQ ID NOs: 434 and 436) variants.

C. Analyses of Meganuclease Activity of TS21 and TS14 Variants in Soybean

Genes encoding the TS21 and TS14 variant meganucleases were optimized for expression in plants. The engineered meganuclease expression cassettes contained the plant codon-optimized nucleotide sequences for better performance in soybean. The plant expression vectors for these soy variants were made by the same methods as described in U.S. patent application Ser. No. 13/427,138. The soybean ubiquitin promoter and the potato proteinase inhibitor II gene terminator sequences were used for controlling meganuclease expression in soybean. The methods used for soybean transformation, qPCR and genomic PCR assays for the TS21 and TS14 target sites were as described in United States patent application Ser. No. 13/427,138. The qPCR assays specific to the TS21 and TS14 recognition sequences were used to identify sequence changes. All hygromycin resistant soybean transgenic events were analyzed by qPCR assays. Changes in the meganuclease target sequence caused by DNA cleavage and repair result in the copy number reduction of the meganuclease target site from two copies in wild type soybean genome to either one or zero copies in the transgenic events. From qPCR analyses of the TS21 and TS14 target sites, it was shown that the copy numbers of the target sites in most of the positive transgenic events were reduced by half, indicating one allele of the recognition sites in soybean genome was disrupted by meganuclease cutting/DNA repair mechanism. As shown in Table 17, introducing the same amino acid modifications (mutations) as LIG3-4 variants into the TS21 meganuclease resulted in a dramatic increase of TS21 target site mutation rates for the TS21(7) variant meganuclease (32.1%) and the TS21(15) variant meganuclease (17.2%), a moderate increase for the TS21 (B65) variant meganuclease when compared to the parental TS21 meganuclease (8.7%). As shown in Table 18, introducing the LIG3-4 (15) mutation into TS14 meganuclease resulted in a decrease of TS14 target site mutation rate from 16% for the parental TS14 meganuclease to 4% mutation rate for the TS14(15) variant meganuclease.

TABLE 17

Activity of TS21 variant meganucleases as determined by target site qPCR hit rate (TS mutation rate) in soybean

| Meganuclease | Number of events analyzed | TS Mutation Rate |
|---|---|---|
| TS21 | 184 | 8.7% |
| TS21 (7) | 187 | 32.1% |
| TS21 (15) | 192 | 17.2% |
| TS21 (B65) | 134 | 12.7% |

TABLE 18

Activity of TS14 variant meganuclease as determined by target site mutation rate (TS mutation rate) in soybean

| Meganuclease | Number of events analyzed | TS Mutation Rate |
|---|---|---|
| TS14 | 183 | 16% |
| TS14 (15) | 192 | 4% |

SEQUENCE LISTING (440 sequences)

SEQ ID NO: 1 - protein, 350 aa, artificial sequence
  LIG3-4
MNTKYNKEFLLYLAGFVDGDGSIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 2 - DNA, 22 bp, zea mays
atatacctcacacgtacgcgta

SEQ ID NO: 3 - protein, 163 aa, Chlamydomonas reinhardtii
MNTKYNKEFLLYLAGFVDGDGSIIAQIKPNQSYKFKHQLSLAFQVTQKTQRRWFLDKLVDEIGVGYVRDRGSVSDYILSEIKPLHNFLTQLQPFLKLKQKQANLVLKIIWRLPSAKESPDKFLEVCTWVDQIAALNDSKTRKTTSETVRAVLDSLSEKKKSSP

SEQ ID NO: 4 - protein, 171 aa, Carteria lunzensis
MNKFTPDQLLYLAGLIDGDGSIIAQLVSRKDYTWEFQIRLTVQVTQLKKRRWFLEELQKEIGAGSVRDRDTVSDYILTETSNVYKFLKDLQPHLRLKQKQANLVLRIIEQLPSSKASKEIFLELCNVVDHVATLNDTKKRKYTAEIVAAKLKELKECVVPVETSEETNSGI

SEQ ID NO: 5 - protein, 167 aa, Scenedesmus obliquus
MTNNNMQNKGMKIIDKDELIYLAGFIDGDGSLIAQMVRRHDYKFKYQIKCTVQITQLKKRRHFLEKIQESIGYGIIRDRGTISDYVLVEPKCVYWLLKQLSPFLRLKKKQADLIIRIIEQLTSSKNSAVLFVQLCRLTDQVALLNDSKSRTITAEVVETTLRELGLI

SEQ ID NO: 6 - protein, 166 aa, Haematococcus lacustris
MKNINSTRFSHLTNEQKAYLAGFIDCDGSLMAQIVRKPDYAYKFQIRVTIQLSQRTSRIHFLKEIASEVGYGYVVSRNNMSDYVITQANIVYELLSLLLPYLRMKVKQANLILKIIQELPSAKVSKDKFIELCILANQVSILNTPNKILKNTWQVVKAELESEDLQ

SEQ ID NO: 7 - protein, 162 aa, Mesostigma viride
MKLIDEKVCAYIAGFLDGDGCLMAQIIKGVYKYKFRIRLSIVFYQHAKRKWFLLQLKKLFDDIGYVRIHKTNNMCDYTITGSRSIEHILLQLMPYIQLKKTSAALMLQLIKKEKLVTTKADFIEVCQLVDKIAEQNFSKKRIITSKVVEATLMLPVETEKSS

SEQ ID NO: 8 - protein, 165 aa, Oltmannsiellopsis viridis
MVIPREDLLNITMNLTEQEKIYLGGFVDGDGCINAQIVRRKDYLLKFQIRVTVSFYQKTKRHWFIKWVHKKLKYGSIRKRNDGMSEYNIVGNHAVKKVVNELQPYIRIKQPQVRLVLEIIEKLPEAKDPLTFVALCERVDLFERLNDSKKRVITSETVRSELGID

SEQ ID NO: 9 - protein, 168 aa, Trichosarcina mucosa
MSKLKKLTPEELCYLAGFLDGDGCINAQIVRRSDYKLKFQIRVSITFFQKTNRHWFLIWLDKKLDCGTLRKRPDKMSEYAIIGIASVRNILLLFKPYLKLKKRQAILLLKVIEKMPSTQNDPQAFFKLCEQVDQFSEFNDSKKRKLTSQVVRSEIGTAIHLFPVETET

SEQ ID NO: 10 - protein, 170 aa, Chlorokybus atmophyticus
MNVIKESEKAYIAGFLDGDGCINAQLVRRSGYRLLYQIRVSITFFQSSKRHWFLLQLHKRLGCGSVRKRNDGISEYCIVGIASVSAVCEQLLPYLRLKRRQAVLICTIIKSLSRHQSKEDFLSLCELADQISFLNNSKKRSNTACLVRKELDLLFPVETSDTKVGDTSSG

SEQ ID NO: 11 - protein, 164 aa, Acanthamoeba castellanii
MQKNQFKKLNNEQLAYLAGFVEADGCFLVQIIPGLQYRYKHTIRISIVFYQKKDKHWYFLQLKNLIGLGSIRFRNDGMLEYSITGLSLVNKFLEMLFPYLILKKNLAVLIFRIIKGLNDVKNEAGFLEVCKLVDEVADHTYSKKRKNTSLTVKNSLLLPVETEE

SEQ ID NO: 12 - protein, 167 aa, Scherffelia dubia
MNKLTKLQENELAYIAGFIDGDGCINAQIIRRVDYKLKFQIRFSVTIIQKTSRHWVVLWFQKKLGCGQIRKRNDGISEYSLVGKNDVQNFLQLIKPFLKVKRRQAQLILEICQQISKEQDPQSFVKLCERVDSIAKLNDSKKRIITSDVVRSILLNSVQKFPVETET

SEQ ID NO: 13 - protein, 168 aa, Pseudendoclonium akinetum
MSKLKKIIPEELSYLAGFLDGDGCINAQIVRRSDYKLKFQIRVSITFFQKTNRHWFLIWLDKKLDCGTLRKRPDGMSEYAIIGIASVRNLLSILKPYLKLKKRQAILLLKIIEKMPHIQNDPQLFLKLCEQVDHFSEFNDSKKRKLTSQVVRSEIGETLNLFPVETET

SEQ ID NO: 14 - protein, 350 aa, artificial sequence
  LIG3-4(7)
MNTKYNKEFLLYLAGIVDGDGSIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEGLRAGATKSKEFLLYLAGFVDGDGSIIASIKPRQCYKFKHELRLEFTVTQKTQRRWFLDELVDEIGVGYVYDRGSVSDYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 15 - protein, 350 aa, artificial sequence
  LIG3-4(15)
MNTKYNKEFLLYLAGFVDSDGSIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 16 - protein, 350 aa, artificial sequence
  LIG3-4(A4)
MNTKYNKEFLLYLAGFVDGDGSIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQVAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQVAALNDSKTRKTTSETVRAVLDSLSEKKKSSP

SEQ ID NO: 17 - protein, 350 aa, artificial sequence
  LIG3-4(A6)
MNTKYNKEFLLYLAGFVDGDGSIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQVAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 18 - protein, 350 aa, artificial sequence
  LIG3-4(B1)
MNTKYNKEFLLYLAGFVDGDGCIKAQIKPNQSCKFKHQLSLTFQVTQKTQRRWFLDKLVDEIGVGYVYDRPSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 19 - protein, 350 aa, artificial sequence
  LIG3-4(B15)
MNTKYNKEFLLYLAGFVDGDGCIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 20 - protein, 350 aa, artificial sequence
  LIG3-4(B16)
MNTKYNKEFLLYLAGFVDGDGCIKAQIKPNQSCKFKHQLSLTFQVTQKTKRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 21 - protein, 350 aa, artificial sequence
  LIG3-4(B24)
MNTKYNKEFLLYLAGFVDGDGCIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 22 - protein, 350 aa, artificial sequence
  LIG3-4(B36)
MNTKYNKEFLLYLAGFVDGDGSIKAQIKPNQSCKFKHQLSLTFQVTQKTQRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 23 - protein, 350 aa, artificial sequence
  LIG3-4(B38)
MNTKYNKEFLLYLAGFVDGDGCIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRPSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 24 - protein, 350 aa, artificial sequence
  LIG3-4(B39)
MNTKYNKEFLLYLAGFVDGDGCIKAQIKPNQSCKFKHQLSLTFQVTQKTQRRWFLDKLVDEIGVGYVYDRPSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRPSVSDYRLSQIKPLHNFLTQLQPFLKLKQKQANLVLKIIEQLPSAKESPDKFLEVCTWVDQIAALNDSKTRKTTSETVRAVLDSLSENNKSSP

SEQ ID NO: 25 - protein, 350 aa, artificial sequence
  LIG3-4(B40)
MNTKYNKEFLLYLAGFVDGDGSIKAQIKPNQSCKFKHQLSLTFQVTQKTKRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 26 - protein, 350 aa, artificial sequence
  LIG3-4(B55)
MNTKYNKEFLLYLAGFVDGDGCIKAQIKPNQSCKFKHQLSLTFQVTQKTQRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGCIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 27 - protein, 350 aa, artificial sequence
  LIG3-4(B65)
MNTKYNKEFLLYLAGFVDGDGCIKAQIKPNQSCKFKHQLSLTFQVTQKTKRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 28 - protein, 350 aa, artificial sequence
  LIG3-4(B70)
MNTKYNKEFLLYLAGFVDGDGCIKAQIKPNQSCKFKHQLSLTFQVTQKTKRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRPSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 29 - protein, 350 aa, artificial sequence
  LIG3-4(B71)
MNTKYNKEFLLYLAGFVDGDGCIKAQIKPNQSCKFKHQLSLTFQVTQKTQRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRPSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 30 - protein, 350 aa, artificial sequence
  LIG3-4(B73)
MNTKYNKEFLLYLAGFVDGDGCIKAQIKPNQSCKFKHQLSLTFQVTQKTQRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 31 - protein, 350 aa, artificial sequence
  LIG3-4(B75)
MNTKYNKEFLLYLAGFVDGDGCIKAQIKPNQSCKFKHQLSLTFQVTQKTKRRWFLDKLVDEIGVGYVYDRPSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 32 - protein, 350 aa, artificial sequence
  LIG3-4(B76)
MNTKYNKEFLLYLAGFVDGDGCIKAQIKPNQSCKFKHQLSLTFQVTQKTKRRWFLDKLVDEIGVGYVYDRGSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 33 - protein, 350 aa, artificial sequence
  LIG3-4(B78)
MNTKYNKEFLLYLAGFVDGDGCIKAQIKPNQSCKFKHQLSLTFQVTQKTQRRWFLDKLVDEIGVGYVYDRPSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSENNKSSP

SEQ ID NO: 34 - protein, 350 aa, artificial sequence
  LIG3-4(B82)
MNTKYNKEFLLYLAGFVDGDGCIKAQIKPNQSCKFKHQLSLTFQVTQKTKRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGCIIASIKPRQCYKFKHELRLEFTVTQKTQRRWFLDKLVDEIGVGYVYDRKSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 35 - protein, 350 aa, artificial sequence
  LIG3-4(C1)
MNTKYNKEFLLYLAGFVDGDGCIKAQIKPNQSCKFKHQLSLTFQVTQKTQRRWFLDKLVDEIGVGYVYDRKSVSDYELSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKLKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSENNKSSP

SEQ ID NO: 36 - protein, 350 aa, artificial sequence
  LIG3-4(D5)
MNTKYNKEFLLYLAGFVDGDGSIKAQIKPNQSCKFKHQLSLTFQVTQKTQRRWFLDKLVDEIGVGYVYDRGSVSDYELSQKKPLHNFLTQLQPFLKLKQKQAVLVLKIIEQLPSAKESPDKFLEVCTWVDQIAALNDSKTRKTTSETVRAVLMSLPGSVGGLSPSQASSAASSASSSPGSGISEALRAGATKSKEFLLYLAGFVDGDGSIIASIKPRQCYKFKHELRLEFTVTQKTQRRWFLDKLHDEIGVGYVYDRGSVSDYRLSQIKPLHNFLTQLQPFLKLKQKQANLVLKIIEQLPSAKESPDGFLEVCTWVDQIAALNDSKTRKTTSETVRAVLDSLSEKKKSSP

SEQ ID NO: 37 - protein, 350 aa, artificial sequence
  LIG3-4(D7)
MNTKYNKEFLLYLAGFVDGDGSIKAQIKPNQSCKFKHQLSLTFQVTQKTRRRWFLLKLVDEIGVGYVYDRGSVSDYELSQKKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 38 - protein, 350 aa, artificial sequence
  LIG3-4(D8)
MNTKYNKEFLLYLAGFVDGDGSIKAQIKPNQSCKFKHQLSLTFQVTQKTQRRWILDKLHDEIGVGYVYDRGSVSDYELSQIKPLHNFLTQLQPFLKLKQKQANLVLKIIEQLPSAKESPDGFLEVCTWVDQIAALNDSKTRKTTSETVRAVLDSLPGSVGGLSPSQASSAASSASSSPGSGISEALRAGATKSKEFLLYLAGFVDGDGSIIASIKPRQCYKFKHELRLEFTVTQKTQRRWFLDKLVDEIGVGYVYDRGSVSDYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 39 - DNA, 1050 bp, artificial sequence
  LIG3-4maize
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcagcgagaagaagaagtcgtccccc

SEQ ID NO: 40 - DNA, 1050 bp, artificial sequence
  LIG3-4yeast
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 41 - DNA, 1050 bp, artificial sequence
  LIG3-4(7)
atgaacaccaagtacaacaaggagttcctgctctacctggccggcatcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaaggactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacgagctggtcgacgagatcggggtgggctacgtctacgaccgcgggtcggtgtccgactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggccgaccagatcgcggccctcaacgacagcaagacccgcaagacgacctcggagacggtgcgggcggtcctggactccctcagcgagaagaagaagtcgtccccc

SEQ ID NO: 42 - DNA, 1050 bp, artificial sequence
  LIG3-4(15)
atgaacaccaagtacaacaaggagttcctgctctacctggccggcttcgtggacagcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcagcgagaagaagaagtcgtccccc

SEQ ID NO: 43 - DNA, 1050 bp, artificial sequence
  LIG3-4(A4)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccaggtcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggaccaagtcgccgcgttaaatgattcaaaaacgaggaaaaccacgagcgaaaccgtcagagccgtgttagatagtttatcagaaaagaagaaaagcagtccg

SEQ ID NO: 44 - DNA, 1050 bp, artificial sequence
  LIG3-4(A6)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccaggtcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctatttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 45 - DNA, 1050 bp, artificial sequence
  LIG3-4(B1)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcccatcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 46 - DNA, 1050 bp, artificial sequence
  LIG3-4(B15)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 47 - DNA, 1050 bp, artificial sequence
  LIG3-4(B16)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 48 - DNA, 1050 bp, artificial sequence
  LIG3-4(B24)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 49 - DNA, 1050 bp, artificial sequence
  LIG3-4(B36)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 50 - DNA, 1050 bp, artificial sequence
  LIG3-4(B38)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggccaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 51 - DNA, 1050 bp, artificial sequence
  LIG3-4(B39)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcccatcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggccaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaataataaaagcagtccg

SEQ ID NO: 52 - DNA, 1050 bp, artificial sequence
  LIG3-4(B40)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 53 - DNA, 1050 bp, artificial sequence
  LIG3-4(B55)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggtgcataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 54 - DNA, 1050 bp, artificial sequence
  LIG3-4(B65)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccagcgtcgttggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 55 - DNA, 1050 bp, artificial sequence
  LIG3-4(B70)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggccaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 56 - DNA, 1050 bp, artificial sequence
  LIG3-4(B71)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggccaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 57 - DNA, 1050 bp, artificial sequence
  LIG3-4(B73)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 58 - DNA, 1050 bp, artificial sequence
  LIG3-4(B75)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcccatcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 59 - DNA, 1050 bp, artificial sequence
  LIG3-4(B76)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 60 - DNA, 1050 bp, artificial sequence
  LIG3-4(B78)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcccatcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaataataaaagcagtccg

SEQ ID NO: 61 - DNA, 1050 bp, artificial sequence
  LIG3-4(B82)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgaaaaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggtgcataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggaaaagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 62 - DNA, 1050 bp, artificial sequence
  LIG3-4(C1)
atgaacaccaagtacaacaaggagttcctgctctacctggccggcttcgtggacggcgacggctgtatcaaggcgcagatcaagccgaaccagtcctgcaagttcaagcaccagctctccctgaccttccaggtgacccagaagacgcaaaggcgctggttcctcgacaagctggtcgacgagatcggggtgggctacgtctacgaccgcaagtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaattgaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaataataaaagcagtccg

SEQ ID NO: 63 - DNA, 1050 bp, artificial sequence
  LIG3-4(D5)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagaaaaagcccctgcacaacttcctcacccagctccagccgttcctcaagctgaagcagaagcaggcggtcctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattacacgatgaaataggcgtcgggtatgtgtatgataggggcagcgtcagtgattataggttaagtcaaatcaaaccgttacataattttttaacgcaattacaaccctttttaaaattaaaacaaaaacaagccaatttagtgttaaaaataatagaacaattaccgagcgcgaaagaaagtcccgatggatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 64 - DNA, 1050 bp, artificial sequence
  LIG3-4(D7)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcggaggcgctggttcctcctgaagctggtcgacgagatcggggtgggctacgtctacgaccgcgggtcggtgtccgactacgagctctcccagaaaaagccgctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagatcgcggccctcaacgacagcaagacccgcaagacgacctcggagacggtgcgggcggtcctgttgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 65 - DNA, 1050 bp, artificial sequence
  LIG3-4(D8)
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggatcctcgacaagctgcacgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacggcttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaggcaatgttataaatttaaacatgaattaaggttagaatttacggtcacgcaaaaaacccaacgtaggtggtttttagataaattagtggatgaaataggcgtcgggtatgtgtatgataggggcagcgtcagtgattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 66 - DNA, 67 bp, artificial sequence
  MN031 primer
aaaaactatatctagacatatggccccgaagaagaagcgcaaggtgatgaacaccaagtacaacaag

SEQ ID NO: 67 - DNA, 40 bp, artificial sequence
  MN022 primer
aattacatgactcgagttaatggtgatggtgatggtgagg

SEQ ID NO: 68 - DNA, 7753 bp, artificial sequence
  pVER8134  (with LIG34=500-1549)
tgaagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggattctagacatatggccccgaagaagaagcgcaaggtgatgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcagcgagaagaagaagtcgtctcctcaccatcaccatcaccattaactcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctc

SEQ ID NO: 69 - DNA, 27 bp, artificial sequence
  nuclear localization signal yeast
atggccccgaagaagaagcgcaaggtg

SEQ ID NO: 70 - protein, 9 aa, artificial sequence
  nuclear localization signal
MAPKKKRKV

SEQ ID NO: 71 - protein, 6 aa, artificial sequence
  6X histidine tag
HHHHHH

SEQ ID NO: 72 - DNA, 30 bp, artificial sequence
  nuclear localization signal maize
atggccccgaagaagaagcgcaaggtgatc

SEQ ID NO: 73 - DNA, 1269 bp, artificial sequence
  LIG3-4(7) maize (include NLS and ST-LS1 INTRON2)
atggcaccgaagaagaagcgcaaggtgatcatgaacaccaagtacaacaaggagttcctgctctacctggccggcatcgtggacggcgacggatccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaaggactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacgagctggtcgacgagatcggggtgggctacgtctacgaccgcgggtcggtgtccgactaccgcctctcccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccc

SEQ ID NO: 74 - DNA, 1269 bp, artificial sequence
  LIG3-4(15) maize (include NLS and ST-LS1 INTRON2)
atggcaccgaagaagaagcgcaaggtgatcatgaacaccaagtacaacaaggagttcctgctctacctggccggcttcgtggactccgacggatccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 75 - DNA, 1269 bp, artificial sequence
  LIG3-4(B65) maize (include NLS and ST-LS1 INTRON2)
atggcaccgaagaagaagcgcaaggtgatcatgaacaccaagtacaacaaggagttcctgctctacctggccggcttcgtggacggcgacggatgcatcaaggcgcagatcaagccgaaccagtcctgcaagttcaagcaccagctctccctgaccttccaggtgacccagaagacgaagaggcgctggttcctcgacaagctggtcgacgagatcggggtgggctacgtctacgaccgcaagtcggtgtccgactacgagctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcaagtcggtgtccgactaccgcctctcccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 76 - DNA, 15979 bp, artificial sequence
  plasmid PHP46961
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggctggatggcggggccttgatcgtgcaccgccggcgtccggactaactaactagtcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccaccggtggtacctggcgaaagggggatgtgctgcaaggcgattaagttgggtaacgccagggttttcccagtcacgacgttgtaaaacgacggccagtgaattgtaatacgactcactatagggcgaattgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatcatgaacaccaagtacaacaaggagttcctgctctacctggccggcttcgtggactccgacggatccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcgttggacggcacgacgtagggggggaactcgtcgcggccgttggcggcagccgataggttcatcatcttcccacgccccggccggcacgttgacacgatatctcgatcgatcggtcggcccggccgcccgatctgtgcaggtgcaggtcgcgcgggcgggcgcggctagctgggagcctgggaggggaggaggggccggagggagcaggagcaggagtgcccgcgcgcgcacacacgagcacacggaaatggatgcgtaggggacggaggggaggacggcggcaaggacagcgcttagcggagagctcggtggagatcgatcgctcagtcggtcgcaggtggacgagcgacagacagagctaatacggcggtgttggccggccgggccatggtgtgggtgatggcgatgacacagatatatgcgcgggcgggcgccagctagtagccgggcagctagcgcgcgcccttctcggccggccggatctcttttgctgcggagagggagagggcgagagcgagggccgagagcgcgagtacttttggtctagggttccatggaacgagtggtggtggagtgagttttgggctatatctaagagcgacgcccgcagctcagctagcaacaaaccgggcgctggcactgacagggccggccagtagagagagagagagagatctttaattggagttggtgagtggtgatagcagccgcagctgctgctgctgctgctgctgcttctttgtggttggtttggttcgccctccatttttcctcacccgggagtccgtatgctatctgctatatgctaggctggctgtgggtgtctatgtatgtatcctcctcctccgttgaaacaacgtagcgtacgacactgctgcatgtgtggccttgaagatatgagtatctatgcatgatgcggatgctgtacatgtgcattgcatcgctcttctctctccctgcggtggtgtgtacgagacggtgggtacgtacgctaacgctagcagctgcctcccgcgtgacgccaggggcagcccggccggacgcggtgtttcgttccatgaccatgaggcgtgatctcagtcatggcccaactacgccaggggcttgcattgcccgcgcgcgtagactttgcacctgcgcatgtatgtatgtacatcctgcagcgcacagcagactgagctgtattcccgcgcaaatgagtagcagcgcacgtatatatacgcgtacgcgtacaagggcgaattccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctccgcgccgccggctacaagcacggcggctggcacgacgtcggcttctggcagcgcgacttcgagctgccggccccgccgcgcccggtgcgcccggtgacgcagatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacaattcgcccttgtgtgaggtatatatatcctccgccggggcacgtacggtacaattcccagcaggtgcgtaaatcgttacagtatattatttccgcagccgatcaaaagaagtttgcgcgtcgtcacggcactgacttctatttagggcggccagagtaggctagcctgctggaccctctgtgtcccgtctatctcattcattcactcatcagctggtgctctatttttctctccctaattaagctggtggaaatttcgtgcttttcgtttgcaccgtgtgccattggatcggatctgatatatatgcgcgcggccgtccgagaccttattactcgtcaccttcttcaacctaacccccccccccccccctttaatttgctagccctaactggcaccatatatcattttgcccacacataataaacgactcctttgccaactgcaccagtcacttggcaaacgactaattacactcggcaaaaggttttgtcgtgtgccacactcgtcaaagagctcttggtgaaacaaacgccggtaacgatctctttgctgagcgccaacatactcggcatagaaggtacattaacggcgggcatcatggtgatgggaaactacctttttgcctagtgtattgttttgccgaggagggtggtattcggcaaatcatatatttgccgagtgctcgctctcagcaaacgtgtgagcactcggcaaagagcgtgtctccagttgtgttgtcattatctattttttttaacctacggcatgccaccaccaaaggttttaattgtcaggaactttctgtattgtagttttaattatataagttgttctccatcaggacttcgaggtcatgttgtatgatcaatggaagaatctcaagacggactcaaagagtggactctcgtcatggattaaaggtgtatttactgcaaggaaaagtgcaggcaatattcagtactcgagagaatctacattttactcttagctcatcacctatgtgggataggtgaaggcgtgaagcactccgagtcttcttggctattcaaagtttccttttcactttgctttccttttggtgtattatagcacacagttttctatgggtcaagggcgaattgtagaattaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacagtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggacttccattgttcattccacggacaaaaacagagaaaggaaacgacagaggccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccaagcactcccgaggggaaccctgtggttggcatgcacatacaaatggacgaacggataaaccttttcacgcccttttaaatatccgttattctaataaacgctcttttctcttag

SEQ ID NO: 77 - DNA, 1097 bp, artificial sequence
  LIG3-4(HR1)
gtgtgaggtatatatatcctccgccggggcacgtacggtacaattcccagcaggtgcgtaaatcgttacagtatattatttccgcagccgatcaaaagaagtttgcgcgtcgtcacggcactgacttctatttagggcggccagagtaggctagcctgctggaccctctgtgtcccgtctatctcattcattcactcatcagctggtgctctatttttctctccctaattaagctggtggaaatttcgtgcttttcgtttgcaccgtgtgccattggatcggatctgatatatatgcgcgcggccgtccgagaccttattactcgtcaccttcttcaacctaacccccccccccccccctttaatttgctagccctaactggcaccatatatcattttgcccacacataataaacgactcctttgccaactgcaccagtcacttggcaaacgactaattacactcggcaaaaggttttgtcgtgtgccacactcgtcaaagagctcttggtgaaacaaacgccggtaacgatctctttgctgagcgccaacatactcggcatagaaggtacattaacggcgggcatcatggtgatgggaaactacctttttgcctagtgtattgttttgccgaggagggtggtattcggcaaatcatatatttgccgagtgctcgctctcagcaaacgtgtgagcactcggcaaagagcgtgtctccagttgtgttgtcattatctattttttttaacctacggcatgccaccaccaaaggttttaattgtcaggaactttctgtattgtagttttaattatataagttgttctccatcaggacttcgaggtcatgttgtatgatcaatggaagaatctcaagacggactcaaagagtggactctcgtcatggattaaaggtgtatttactgcaaggaaaagtgcaggcaatattcagtactcgagagaatctacattttactcttagctcatcacctatgtgggataggtgaaggcgtgaagcactccgagtcttcttggctattcaaagtttccttttcactttgctttccttttggtgtattatagcacacagttttctatggg

SEQ ID NO: 78 - DNA, 1242 bp, artificial sequence
  LIG3-4(HR2)
gcggccgcgttggacggcacgacgtagggggggaactcgtcgcggccgttggcggcagccgataggttcatcatcttcccacgccccggccggcacgttgacacgatatctcgatcgatcggtcggcccggccgcccgatctgtgcaggtgcaggtcgcgcgggcgggcgcggctagctgggagcctgggaggggaggaggggccggagggagcaggagcaggagtgcccgcgcgcgcacacacgagcacacggaaatggatgcgtaggggacggaggggaggacggcggcaaggacagcgcttagcggagagctcggtggagatcgatcgctcagtcggtcgcaggtggacgagcgacagacagagctaatacggcggtgttggccggccgggccatggtgtgggtgatggcgatgacacagatatatgcgcgggcgggcgccagctagtagccgggcagctagcgcgcgcccttctcggccggccggatctcttttgctgcggagagggagagggcgagagcgagggccgagagcgcgagtacttttggtctagggttccatggaacgagtggtggtggagtgagttttgggctatatctaagagcgacgcccgcagctcagctagcaacaaaccgggcgctggcactgacagggccggccagtagagagagagagagagatctttaattggagttggtgagtggtgatagcagccgcagctgctgctgctgctgctgctgcttctttgtggttggtttggttcgccctccatttttcctcacccgggagtccgtatgctatctgctatatgctaggctggctgtgggtgtctatgtatgtatcctcctcctccgttgaaacaacgtagcgtacgacactgctgcatgtgtggccttgaagatatgagtatctatgcatgatgcggatgctgtacatgtgcattgcatcgctcttctctctccctgcggtggtgtgtacgagacggtgggtacgtacgctaacgctagcagctgcctcccgcgtgacgccaggggcagcccggccggacgcggtgtttcgttccatgaccatgaggcgtgatctcagtcatggcccaactacgccaggggcttgcattgcccgcgcgcgtagactttgcacctgcgcatgtatgtatgtacatcctgcagcgcacagcagactgagctgtattcccgcgcaaatgagtagcagcgcacgtatatatacgcgtacgcgtac

SEQ ID NO: 79 - DNA, 18 bp, artificial sequence
  LIG3-4 target site qPCR probe
atacctcacacgtacgcg

SEQ ID NO: 80 - DNA, 20 bp, artificial sequence
  Lig3-4_forward primer
gatttacgcacctgctggga

SEQ ID NO: 81 - DNA, 20 bp, artificial sequence
  Lig3-4_reverse primer
ctgagctgtattcccgcgca

SEQ ID NO: 82 - DNA, 3716 bp, Saccharomyces cerevisiae
ctactagaaagaagggcgtcaaaaatctgctatgctattacgaaattactctataggttagaatgtcatcccataggtatggcccttttaaagaagtatctccacaatcaattgcgagaagcctatctagaatcaaaacgacactttatttccaaaaagggagattcgaccaacacttcctctaccattgcatcatcatctttcgctggcgcatctgttcctctatcttcaaacgaatcaggaatgctaaacggcttgaagcaaattaacgaacaacaagaatctacattagaaaccactcaaaaggaagactagtaacgccgtatcgtgattaacgtattacataagttacaggattcatgcttatgggttagctatttcgcccaatgtgtccatctgacattactattttgcattttaatttaattagaacttgactagcgcactaccagtatatcatctcatttccgtaaataccaaatgtattatatattgaaagcttttgaccaggttattataaaagaaacttcatgctcgaaaaagatcatttcgaaaagttgcctagtttcatgaaattttaaagcagtttatataaattttaccttttgatgcggaattgactttttcttgaataatacataacttttcttaaaagaatcaaagacagataaaatttaagagatattaaatattagtgagaagccgagaattttgtaacaccaacataacactgacatctttaacaacttttaattatgatacatttcttacgtcatgattgattattacagctatgctgacaaatgactcttgttgcatggctacgaaccgggtaatactaagtgattgactcttgctgaccttttattaagaactaaatggacaatattatggagcatttcatgtataaattggtgcgtaaaatcgttggatctctcttctaagtacatcctactataacaatcaagaaaaacaagaaaatcggacaaaacaatcaagtatggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaatatataagtttattgatatacttgtacagcaaataattataaaatgatatacctattttttaggctttgttatgattacatcaaatgtggacttcatacatagaaatcaacgcttacaggtgtccttttttaagaatttcatacataagatcacttattatacatacatacatatccagtaacaagaagcaaggaataattacctgcttaagtctgcgattaaaaaaataacgtttcgatacagttcatataaggcggctcaatgcagaaccgaggatagcgctacgtcaggatatctttgtagttcccaaatataaatgcgacaatatagtttctttctttcatatcaataatatccttttctccactgaaatcacgaatcaaacctggagcaaaaactaaagccaaattataaagcgtcattcgattccagtgactgtaccgtgtaaccttttctatatgttcactcagtactcttaacaccctataatgttcccttggaaggtcttccaatatgttttttaaagcgctcttgctcgacatataagtgtccgaattctttgcttctaaggacaactttcctccaacaaatggcaagttttccatcatttttttagatttaactaacctcatcaacggctcgtatatttgaaaggtaaagatagggttggggagctttcttaagtatcgcttcaacacaccagtaacaacgttgagatcttgttccgttaaaatatttggcgtttcggtattttgttgtactttccatgcagaaaattgcttttctatttcttctatgactagctgggaacctgattttctataaatgccctccgatctcatattttcttcgtctgattcaataaaatctatgcagacagatagtatcatcggtatttcattgttttcataattgcacctagcaacgagacttgaaccatacaaattgcttccatccaaatattcttctccatctttactttgtcccatatttgcatcg

SEQ ID NO: 83 - DNA, 1713 bp, Saccharomyces cerevisiae
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaag

SEQ ID NO: 84 - DNA, 3099 bp, artificial sequence
  pHD1327 ade-de2 with ZM6.22-MHP42-MHP107-ZM6.3-LIG3-4
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaaggcgcgccattgctctctcacatacttttagtttctcacgcgtgagagccttctagtatacgtgagagaccttgcaggctctcgtaaatgcgcctgctcgagatatacctcacacgtacgcgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaag

SEQ ID NO: 85 - DNA, 22 bp, zea mays
gggcggtatgtatgtcatacta

SEQ ID NO: 86 - protein, 350 aa, artificial sequence
  MHP77
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 87 - protein, 350 aa, artificial sequence
  MHP77(L72-01a)
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDADGSIIASIRPEQSRKFKHRLELRFTITQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 88 - protein, 350 aa, artificial sequence
  MHP77(L72-08a)
MNTKYNKEFLLYLAGFVDADGSIIAQIKPEQCYKFKHRLMLTFTVTQKTQRRWFLDKIVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 89 - protein, 350 aa, artificial sequence
  MHP77(L72-09a)
MNTKYNKEFLLYLAGFVDADGSIIAQIKPEQCYKFKHRLMLTFTVTQKTQRRWFLDKIVDEIGVGYVRDRGSVSDYILSQIKPLHNFLTQIQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 90 - protein, 350 aa, artificial sequence
  MHP77(L73-02a)
MNTKYNKEFLLYLAGFVDADGSLIAQIKPEQCYKFKHRLMLTFTVTQKTQRRWFLDKIVDEIGVGYVRDRGSVSDYILSQIKPLHNFLTQIQPFIKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYIYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 91 - protein, 350 aa, artificial sequence
  MHP77(L73-05a)
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDADGSIIASIRPEQSRKFKHRLELRFTVTQKTQRRWFLDKLVDEIGVGYVYDQGSVSHYRLSQIKPLHNFLTQIQPFFKLKQKQTNLVLKIIEQLPSAKESPDKFLEVCTWVDQIAALNDSKTRKTTSETVRAVLDSLSEKKKSSP

SEQ ID NO: 92 - protein, 349 aa, artificial sequence
  MHP77(L9-01)
MNTKYNKEFLLYLAGIVDSDGSIIAQIKPEQCYKFKHRLMLTFTVTQKTRRRWFLDKLHDEIGVGYVRDRGSVSDYILSQKKPLHNFLTQLQPFLKLKQKQANLVLKIIEQLPSAKESPDGFLEVCTWVDQVAALNDSKTRKTTSETVRAVLLSLPGSWEVYRHLRHPAPHPRLPQARVQGSPKHSELEQLSPKSFLYLAGFVDGDGSIIASIRPEQSRKFKHRLELRFTVTQKTQRRWFLDELVDEIGVGYVYDQGSVSHYRLSQIKPLHNFLTQLQPYLKLKQKQANLVLKIIEQLPSAKESPDKFLEVCTWADQVAALNDSKTRKTTSETVRAVLDSLSEKKKSSP

SEQ ID NO: 93 - protein, 350 aa, artificial sequence
  MHP77(L9-02)
MNTKYNKEFLLYLAGFVDGDGSIIAQIKPEQCYKFKHRLMLTFTVTQKTRRRWILDKLVDEIGVGYVRDRGSVSDYILSQKKPLHNFLTQLQPFLKLKQKQAVLVLKIIEQLPSAKESPDGFLEVCTWVDQVAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 94 - protein, 350 aa, artificial sequence
  MHP77(L9-03)
MNTKYNKEFLLYLAGFVDSDGSIIAQIKPEQCYKFKHRLMLTFTVTQKTQRRWILLKLVDEIGVGYVRDRGSVSDYILSQKKPLHNFLTQLQPFLKLKQKQAVLVLKIIEQLPSAKESPDGFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPFLKLKQKQANLVLKIIEQLPSAKESPDKFLEVCTWVDQVAALNDSKTRKTTSETVRAVLDSLSEKKKSSP

SEQ ID NO: 95 - protein, 350 aa, artificial sequence
  MHP77(L9-04)
MNTKYNKEFLLYLAGFVDGDGCIIAQIKPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPYLKLKQKQANLVLKIIEQLPSAKESPDKFLEVCTWADQVAALNDSKTRKTTSETVRAVLDSLSEKKKSSP

SEQ ID NO: 96 - protein, 350 aa, artificial sequence
  MHP77(L9-06)
MNTKYNKEFLLYLAGFVDSDGCIIAQIKPEQCYKFKHRLMLTFTVTQKTRRRWILLKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPFLKLKQKQANLVLKIIEQLPSAKESPDGFLEVCTWVDQVAALNDSKTRKTTSETVRAVLDSLSEKKKSSP

SEQ ID NO: 97 - protein, 350 aa, artificial sequence
  MHP77(L9-09)
MNTKYNKEFLLYLAGIVDSDGCIIAQIKPEQCYKFKHRLMLTFTVTQKTRRRWFLDKLHDEIGVGYVRDRGSVSDYILSQIKPLHNFLTQLQPFLKLKQKQAVLVLKIIEQLPSAKESPDKFLEVCTWVDQVAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPFLKLKQKQANLVLKIIEQLPSAKESPDGFLEVCTWVDQIAALNDSKTRKTTSETVRAVLDSLSEKKKSSP

SEQ ID NO: 98 - protein, 350 aa, artificial sequence
  MHP77(L9-10)
MNTKYNKEFLLYLAGIVDSDGSIIAQIKPEQCYKFKHRLMLTFTVTQKTKRRWILLKLHDEIGVGYVRDRGSVSDYILSQKKPLHNFLTQLQPFLKLKQKQANLVLKIIEQLPSAKESPDGFLEVCTWVDQVAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPFLKLKQKQANLVLKIIEQLPSAKESPDKFLEVCTWVDQVAALNDSKTRKTTSETVRAVLDSLSEKKKSSP

SEQ ID NO: 99 - protein, 350 aa, artificial sequence
  MHP77(L9-11)
MNTKYNKEFLLYLAGFVDGDGSIIAQIKPEQCYKFKHRLMLTFTVTQKTKRRWFLDKLVDEIGVGYVRDRGSVSDYILSQKKPLHNFLTQLQPFLKLKQKQANLVLKIIEQLPSAKESPDGFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 100 - protein, 350 aa, artificial sequence
  MHP77(L9-12)
MNTKYNKEFLLYLAGFVDSDGSIIAQIKPEQCYKFKHRLMLTFTVTQKTQRRWILLKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPYLKLKQKQANLVLKIIEQLPSAKESPDGFLEVCTWVDQIAALNDSKTRKTTSETVRAVLDSLSEKKKSSP

SEQ ID NO: 101 - protein, 350 aa, artificial sequence
  MHP77(L112-03a)
MNTKYNKEFLLYLAGFVDGDGSIIAQIKPEQCYKFKHRLMLTFTVTQKTQRRWFLDKLVDEIGVGYVRDRGTVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYIAGFVDADGSIIASIRPEQSRKFKHRLELRFTVTQKSLRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 102 - protein, 350 aa, artificial sequence
  MHP77(L113-01)
MNTKYNKEFLLYLAGFVDGDGSIIAQIKPEQCYKFKHRLMLTFTVTQKTQRRWFLDKLVDEIGVGYVRDRGTASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFLDADGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 103 - protein, 350 aa, artificial sequence
  MHP77(L13-01a)
MNTKYNKEFLLYLAGFVDGDGSIIAQIKPEQRYKFKHRLMLTFTVTQKTQRRWFLDKLVDEIGVGYVRDRGSVSDYILSQIKPLHNFLTQLQPFLKLKQKQANLVLKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 104 - protein, 350 aa, artificial sequence
  MHP77(L13-02)
MDTKYNKEFLLYLAGFVDGDGSIIAQIRPEQCYKFKHRLMLTLTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 105 - protein, 350 aa, artificial sequence
  MHP77(L13-04)
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 106 - protein, 350 aa, artificial sequence
  MHP77(L13-06)
MNTKYNKEFLLYLAGFVDGDGSIIAQIKPGQCYKFKHRLMLTFTVTQKTQRRWFLDKLVDEIGVGYVRDRGSASDYILSQIKPLHNFLTQLQPFLKLKQKQANLVLKIIERLPSAKESPDKFLEVCTWVDQIAALNDSKTRKTTSETVRAALDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSEAVRAVLDSSSEKKKSSP

SEQ ID NO: 107 - protein, 350 aa, artificial sequence
  MHP77(L13-08a)
MNTKYNKEFLLYLAGFVDGDGSIIAQIKPEQRYKFKHRLMLTFTVTQKTRRRWFLDKLADEIGVGYVRDRGSVSDYILSQIKPLHDFLTQLQPFLKLKQKQANLVLKIIEQLSSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 108 - protein, 350 aa, artificial sequence
  MHP77(L13-10B1)
MNTKYNKEFLLHLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 109 - protein, 350 aa, artificial sequence
  MHP77(L13-11)
MNTKYNKEFLLYLAGFVDGDGSIIAQIKPEQRYKFKHRLMLTFTVTQKTQRRWFLDKLVDEIGVGYVRDRGSVSDYILSQIKPLHNFLTQLQPFLKLKQKQANLVLKIIEQLPPAKESPDKFLEVCTWVDQVAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 110 - protein, 350 aa, artificial sequence
  MHP77(L13-12)
MNTKYNKEFLLYLAGFVDGDGSIIAQIKPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLGSLSEKKKSSP

SEQ ID NO: 111 - protein, 350 aa, artificial sequence
  MHP77(L15-02)
MNTKYNKEFLLYLAGFVDGDGSIIAQIKPEQRYKFKHRLMLTFTVTQKTQRRWFLDKLVDEIGVGYVRDRGSASDYILSQIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLGSLSEKKKSSP

SEQ ID NO: 112 - protein, 350 aa, artificial sequence
  MHP77(L15-03)
MNTKYNKEFLLHLAGFVDGDGSIIAQIKPEQRYKFKHRLMLTFTVTQKTQRRWFLDKLADEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 113 - protein, 350 aa, artificial sequence
  MHP77(L15-05)
MNTKYNKEFLLYLAGFVDGDGSIIAQIKPEQRYKFKHRLMLTFTVTQKTQRRWILDKLVDEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 114 - protein, 350 aa, artificial sequence
  MHP77(L15-06)
MNTKYNKEFLLHLAGFVDGDGSIIAQIKPEQRYKFKHRLMLTFTVTQKTQRRWFLDKLVDEIGVGYVRDRGSASDYILSQIKPLHNFLTQLQPFLKLKQKQANLVLKIIEQLPSAKESPDKFLEVCTWADQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 115 - protein, 350 aa, artificial sequence
  MHP77(L15-08)
MNTKYNKEFLLYLAGFVDGDGSIIAQIKPEQRYKFKHRLMLTFTVTQKTRRRWFLDKLVDEIGVGYVRDRGSVSDYILSQIKPLHNFLTQLQPFLKLKQKQANLVLKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVFDSLSEKKKSSP

SEQ ID NO: 116 - protein, 350 aa, artificial sequence
  MHP77(L15-10)
MNTKYNKEFLLHLAGFVDGDGSIIAQIKPEQCYKFKHRLMLTFTVTQKTRRRWFLDKLADEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 117 - protein, 350 aa, artificial sequence
  MHP77(L15-11)
MNTKYNKEFLLYLAGFVDGDGSIIAQIRPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 118 - protein, 350 aa, artificial sequence
  MHP77(L15-12)
MNTKYNKEFLLHLAGFVDGDGSIIAQIKPEQCYKFKHRLMLTFTVTQKTQRRWFLDKLVDEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 119 - protein, 350 aa, artificial sequence
  MHP77(L15-13)
MNTKYNKEFLLHLAGFVDGDGSIIAQIKPEQRYKFKHRLMLTFTVTQKTQRRWFLDKLADEIGVGYVRDRGSASDYILSQIKPLHNFLTQLQPFLKLKQKQANLVLKIIEQLPSAKESPDKFLEVCTWADQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 120 - protein, 350 aa, artificial sequence
  MHP77(L15-15)
MNTKYNKEFLLHLAGFVDGDGSIIAQIKPEQRYKFKHRLMLTFTVTQKTQRRWFLDKLVDEIGVGYVRDRGSVSDYILSQIKPLHNFLTQLQPFLKLKQKQANLALKIIEQLSSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 121 - protein, 350 aa, artificial sequence
  MHP77(L15-16)
MNTKYNKEFLLYLAGFVDGDGSIIAQIRPEQCYKFKHRLMLTFTVTQKTQRRWFLDKLVDEIGVGYVRDRGSVSDYILSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVFDSLSEKKKSSP

SEQ ID NO: 122 - protein, 350 aa, artificial sequence
  MHP77(L15-18)
MNTKYNKEFLLHLAGFVDGDGSIIAQIKPEQRYKFKHRLMLTFTVTQKTQRRWFLDKLVDEIGVGYVRDRGSVSDYILSQIKPLHDFLTQLQPFLKLKQKQANLVLKIIEQLPSAKESPDKFLRVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 123 - protein, 350 aa, artificial sequence
  MHP77(L15-20)
MNTKYNKEFLLYLAGFVDGDGSIIAQIKPEQRYKFKHRLMLTFTVTQKTQRRWFLDKLVDEIGVGYVRDRGSASDYILSQIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 124 - protein, 350 aa, artificial sequence
  MHP77(L15-21)
MNTKYNKEFLLYLAGFVDGDGSIIAQIKPEQCYKFKHRLMLTFTVTQKTQRRWILDKLVDEIGVGYVRDRGSASDYILSQIKPLHNFLTQLQPFLKLKQKQANLVLKIIEQLSSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 125 - protein, 350 aa, artificial sequence
  MHP77(L15-23)
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLALKIIEQLPSAKESPDKFLRVCTCVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 126 - protein, 350 aa, artificial sequence
  MHP77(L15-24)
MNTKYNKEFLLHLAGFVDGDGSIIAQIKPEQRYKFKHRLMLTFTVTQKTRRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLGSLSEKKKSSP

SEQ ID NO: 127 - protein, 350 aa, artificial sequence
  MHP77(L15-28)
MNTKYNKEFLLHLAGFVDGDGSIIAQIKPEQRYKFKHRLMLTLTVTQKTQRRWFLDKLVDEIGVGYVRDRGSVSDYILSQIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGDVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 128 - protein, 350 aa, artificial sequence
  MHP77(L15-29)
MNTKYNKEFLLYLAGFVDGDGSIIAQIKPEQRYKFKHRLMLTFTVTQKTQRRWILDKLVDEIGVGYVRDRGSVSDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLGSLSEKKKSSP

SEQ ID NO: 129 - protein, 350 aa, artificial sequence
  MHP77(L15-33)
MNTKYNKEFLLHLAGFVDGDGSIIAQIKPEQRYKFKHRLMLTFTVTQKTQRRWFLDKLVDEIGVGYVRDRGSASDYILSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 130 - protein, 350 aa, artificial sequence
  MHP77(L15-34)
MNTKYNKEFLLHLAGFVDGDGSIIAQIKPEQRYKFKHRLMLTFTVTQKTQRRWFLDKLVDEIGVGYVRDRGSASDYILSQIKPLHNFLTQLQPFLKLKQKQANLVLKIIEQLSSAKESPDKFLEVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 131 - protein, 350 aa, artificial sequence
  MHP77(L15-35)
MNTKYNKEFLLYLAGFVDGDGSIIAQIKPEQRYKFKHRLMLTFTVTQKTRRRWFLDKLADEIGVGYVRDRGSVSDYILSQIKPLHDFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 132 - protein, 350 aa, artificial sequence
  MHP77(L15-36)
MNTKYNKEFLLHLAGFVDGDGSIIAQIKPEQCYKFKHRLMLTFTVTQKTRRRWFLDKLVDEIGVGYVRDRGSVSDYILSQIRPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLGSLSEKKKSSP

SEQ ID NO: 133 - protein, 350 aa, artificial sequence
  MHP77(L15-39)
MDTKYNKEFLLHLAGFVDGDGSIIAQIKPEQRYKFKHRLMLTFTVTQKTRRRWFLDKLVDEIGVGYVRDRGSVSDYILSQIKPLHNFLTQLQPFLKLKQKQANLALKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 134 - protein, 350 aa, artificial sequence
  MHP77(L15-40)
MNTKYNKEFLLYLAGFVDGDGSIIAQIKPEQRYKFKHRLMLTFTVTQKTQRRWILDKLVDEIGVGYVRDRGSASDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 135 - protein, 350 aa, artificial sequence
  MHP77(L15-41)
MNTKYNKEFLLYLAGFVDGDGSIIAQIKPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 136 - protein, 350 aa, artificial sequence
  MHP77(L15-42)
MNTKYNKEFLLYLAGFVDGDGSIIAQIKPEQRYKFKHRLMLTFTVTQKTQRRWFLDKLVDEIGVGYVRDRGSVSDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGVSEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVFDSLSEKKKSSP

SEQ ID NO: 137 - protein, 350 aa, artificial sequence
  MHP77(L15-43)
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLSSAKESPDKFLEVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 138 - protein, 350 aa, artificial sequence
  MHP77(L15-45)
MNTKYNKEFLLYLAGFVDGDGSIIAQIKPEQRYKFKHRLMLTFTVTQKTRRRWFLDKLVDEIGVGYVRDRGSVSDYILSQIKPLHNFLTQLQPFLKLKQKQANLALKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 139 - protein, 350 aa, artificial sequence
  MHP77(L15-46)
MNTKYNKEFLLHLAGFVDGDGSIIAQIKPEQRYKFKHRLMLTFTVTQKTRRRWFLDKLVDEIGVGYVRDRGSVSDYILSQIKPLHDFLTQLQPFLKLKQKQANLVLKIIEQLPSAKESPDKFLRVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVFDSLSEKKKSSP

SEQ ID NO: 140 - protein, 350 aa, artificial sequence
  MHP77(L15-27)
MNTKYNKEFLLHLAGFVDGDGSIIAQIKPEQRYKFKHRLMLTFTVTQKTQRRWFLDKLVDEIGVGYVRDRGSASDYILSQIKPLHNFLTQLQPFLKLKQKQANLALKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 141 - protein, 350 aa, artificial sequence
  MHP77(L15-30)
MNTKYNKEFLLYLAGFVDGDGSIIAQIRPEQCYKFKHRLMLTLTVTQKTQRRWFLDKLADEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 142 - protein, 350 aa, artificial sequence
  MHP77(L15-31)
MNTKYNKEFLLYLAGFVDGDGSIIAQIKPEQRYKFKHRLMLTFTVTQKTQRRWILDKLVDEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 143 - protein, 350 aa, artificial sequence
  MHP77(L15-47)
MNTKYNKEFLLHLAGFVDGDGSIIAQIRPEQCYKFKHRLMLTFTVTQKTQRRWFLDKLVDEIGVGYVRDRGSVSDYILSQIKPLHNFLTQLQPFLKLKQKQANLVLKIIEQLPSAKESPEKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 144 - protein, 350 aa, artificial sequence
  MHP77(L16-01)
MNTKYNKEFLLYLAGFVDGDGSIIAQIKPEQRYKFKHRLMLTFTVTQKTQRRWILLKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 145 - protein, 350 aa, artificial sequence
  MHP77(L16-02)
MNTKYNKEFLLYLAGFVDGDGSIIAQIRPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 146 - protein, 350 aa, artificial sequence
  MHP77(L16-03)
MNTKYNKEFLLYLAGFVDSDGSIIAQIKPEQRYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIMASIRPEQSRKFKHRLELRFTVTQKTQRRWFLDELVDEIGVGYVYDQGSVSHYRLSQIKPLHNFLTQLQPYLKLKQKQANLVLKIIEQLPSAKESPDKFLEVCTWADQIAALNDSKTRKTTSETVRAVLDSLSEKKKSSP

SEQ ID NO: 147 - protein, 350 aa, artificial sequence
  MHP77(L16-04)
MNTKYNKEFLLYLAGFVDGDGSIIAQIRPEQRYKFKHRLMLTFTVTQKTRRRWILDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 148 - protein, 350 aa, artificial sequence
  MHP77(L16-05)
MNTKYNKEFLLYLAGFVDGDGSIIAQIKPEQRYKFKHRLMLTFTVTQKTRRRWILDKLVDEIGVGYVRDRGSASDYILSQKKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 149 - protein, 350 aa, artificial sequence
  MHP77(L16-06)
MNTKYNKEFLLYLAGFVDGDGSIIAQIKPEQCYKFKHRLMLTFTVTQKTRRRWILDKLVDEIGVGYVRDRGTASDYILSQIKPLHNFLTQLQPFLKLKQKQANLVLKIIEQLPSAKESPDKFLEVCTWADQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 150 - protein, 350 aa, artificial sequence
  MHP77(L16-07)
MDTKYNKEFLLYLAGFVDGDGSIIAQIKPEQRYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 151 - protein, 350 aa, artificial sequence
  MHP77(L16-08)
MNTKYNKEFLLHLAGFVDGDGSIIAQIKPEQRYKFKHRLMLTFTVTQKTQRRWFLDKLVDEIGVGYVRDRGTASDYILSQIKPLHDFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 152 - protein, 350 aa, artificial sequence
  MHP77(L16-09)
MNTKYNKEFLLYLAGFVDADGSIIAQIKPEQCYKFKHRLMLTFTVTQKTQRRWILLKLVDEIGVGYVRDRGSASDYILSQIKPLHNFLTQLQPFLKLKQKQANLVLKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 153 - protein, 350 aa, artificial sequence
  MHP77(L16-11)
MNTKYNKEFLLYLAGFVDGDGSIIAQIRPEQRYKFKHRLMLTFTVTQKTQRRWILDKLVDEIGVGYVRDRGSASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWADQIAALNDSKTRKTTSETVRAVLDSLSEKKKSSP

SEQ ID NO: 154 - protein, 350 aa, artificial sequence
  MHP77(L16-12)
MNTKYNKEFLLYLAGFVDGDGSIIAQIKPEQRYKFKHRLMLTFTVTQKTQRRWFLDKLVDEIGVGYVRDRGSASDYILSQIKPLHNFLTQLQPFLKLKQKQANLVLKIIEQLPSAKESPDKFLRVCTWVDQVAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 155 - protein, 350 aa, artificial sequence
  MHP77(L16-14)
MNTKYNKEFLLYLAGFVDGDGSIIAQIRPEQRYKFKHRLMLTFTVTQKTRRRWFLDKLADEIGVGYVRDRGSVSDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 156 - protein, 350 aa, artificial sequence
  MHP77(L16-15)
MNTKYNKEFLLYLAGFVDGDGSIIAQIKPEQRYKFKHRLMLTFTVTQKTQRRWILDKLVDEIGVGYVRDRGSASDYILSQKKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFLDADGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 157 - protein, 350 aa, artificial sequence
  MHP77(L16-16)
MNTKYNKEFLLYLAGFVDGDGSIIAQIRPEQRYKFKHRLMLTFTVTQKTQRRWILDKIVDEIGVGYVRDRGSVSDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPYLKLKQKQANLVLKIIEQLPSAKESPDKFLEVCTWVDQIAALNDSKTRKTTSETVRAVFDSLSEKKKSSP

SEQ ID NO: 158 - protein, 350 aa, artificial sequence
  MHP77(L16-17)
MNTKYNKEFLLYLAGFVDGDGSIIAQIKPEQRYKFKHRLMLTFTVTQKTQRRWILLKLVDEIGVGYVRDRGTASDYILSQIKPLHNFLTQLQPFLKLKQKQANLVLKIIEQLPSAKESPDKFLEVCTWVDQVAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 159 - protein, 350 aa, artificial sequence
  MHP77(L16-18)
MDTKYNKEFLLYLAGFVDGDGSIIAQIKPEQRYKFKHRLMLTFTVTQKTRRRWFLDKLVDEIGVGYVRDRGSVSDYILSQIKPLHNFLTQLQPFLKLKQKQANLVLKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 160 - protein, 350 aa, artificial sequence
  MHP77(L16-19)
MNTKYNKEFLLYLAGFVDGDGSIIAQIKPEQCYKFKHRLMLTFTVTQKTRRRWILDKLVDEIGVGYVRDRGSVSDYILSQKKPLHNFLTQLQPFLKLKQKQANLALKIIEQLPPAKESPDKFLEVCTWVDRIAALNDSKTRKTTSETVRAVLDSLPGSVGGLSPSQASSAASSASSSPGSGISEALRAGATKSKEFLLYLAGFLDADGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 161 - protein, 350 aa, artificial sequence
  MHP77(L16-21)
MNTKYNKEFLLYLAGFVDADGSIIAQIKPEQRYKFKHRLMLTFTVTQKTQRRWFLDKLVDEIGVGYVRDRGTASDYILSQIKPLHNFLTQLQPFLKLKQKQANLVLKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIMASIRPEQSRKFKHRLELRFTVTQKTQRRWFLDELVDEIGVGYVYDQGSVSHYRLSQIKPLHNFLTQLQPYLKLKQKQANLVLKIIEQLPSAKESPDKFLEVCTWADQIAALNDSKTRKTTSETVRAVFDSLSEKKKSSP

SEQ ID NO: 162 - protein, 350 aa, artificial sequence
  MHP77(L16-23)
MNTKYNKEFLLYLAGFVDGDGSIIAQIKPEQRYKFKHRLMLTFTVTQKTQRRWILDKLVDEIGVGYVRDRGSASDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 163 - protein, 350 aa, artificial sequence
  MHP77(L16-24)
MNTKYNKEFLLYLAGFVDGDGSIIAQIKPEQCYKFKHRLMLTFTVTQKTQRRWILDKLVDEIGVGYVRDRGSVSDYILSQIKPLHNFLTQLQPFLKLKQKQANLVLKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSRIKPLHNFLTQLQPFLKLKQKQANLVLKIIEQLPSAKESPDKFLEVCTWADQIAALNDSKTRKTTSETVRAVLDSLSEKKKSSP

SEQ ID NO: 164 - protein, 350 aa, artificial sequence
  MHP77(L17-12)
MNTKYNKEFLLYLAGFVDADGSLIAQIKPEQCYKFKHRLMLTFTVTQKTQRRWFLDKIVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 165 - protein, 350 aa, artificial sequence
  MHP77(L18-01)
MNTKYNKEFLLYLAGFVDGDGSIIAQIKPEQCYKFKHRLMLTFTVTQKTQRRWFLDKLVDEIGVGYVRDRGTASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDADGSIIASIRPEQSRKFKHRLELRFTVTQKSLRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 166 - protein, 350 aa, artificial sequence
  MHP77(L18-12)
MNTKYNKEFLLYLAGFVDGDGSIIAQIKPEQCYKFKHRLMLTFTVTQKTQRRWFLDKLVDEIGVGYVRDRGTASDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDADGSIIASIRPEQSRKFKHRLELRFTVTQKTQRRWFLDKLVDEIGVGYVYDQGSVSHYRLSQIKPLHNFLTQIQPFFKLKQKQANLVLKIIEQLPSAKESPDKFLEVCTWVDQIAALNDSKTRKTTSETVRAVLDSLSEKKKSSP

SEQ ID NO: 167 - protein, 350 aa, artificial sequence
  MHP77(L17-01)
MNTKYNKEFLLYLAGFVDADGSIIAQIKPEQCYKFKHRLMLTFTVTQKTQRRWFLDKIVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGYIYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 168 - DNA, 1050 bp, artificial sequence
  MHP77 yeast
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 169 - DNA, 1050 bp, artificial sequence
  MHP77(L72-01a)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctacagccgttcttaaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatctagcggggtttgtcgatgctgatgggagtataatagccagtatacgccccgaacaatcgcgtaaatttaaacatcgcttagaattacgttttacgattacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 170 - DNA, 1050 bp, artificial sequence
  MHP77(L72-08a)
atgaacaccaagtacaacaaggagttcctgctctacctggccggcttcgtggacgctgatggcagcattattgcgcagatcaagccggaacagtgctacaagttcaagcaccggctcatgctgaccttcacagttacccagaagacgcagagacgctggttcctcgacaagatagtcgacgagatcggggtgggctacgttcgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 171 - DNA, 1050 bp, artificial sequence
  MHP77(L72-09a)
atgaacaccaagtacaacaaggagttcctgctctacctggccggcttcgtggacgctgatggcagcattattgcgcagatcaagccggaacagtgctacaagttcaagcaccggctcatgctgaccttcacagtgacccagaagacgcagaggcgctggttcctcgacaagatagtcgacgagatcggggtgggctacgtccgtgaccgcgggtcggtgtccgactacatcctctcccagatcaagcccctgcacaacttcctcacccagatacagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggaccaaatagccgcgttaaatgattcaaaaacgaggaaaaccacgagcgaaaccgtcagagccgtgttagatagtttatcagaaaagaagaaaagcagtccg

SEQ ID NO: 172 - DNA, 1050 bp, artificial sequence
  MHP77(L73-02a)
atgaacaccaagtacaacaaggagttcctgctctatctagccggcttcgtggacgctgatggcagcttaattgcgcagatcaagccggaacagtgctacaagttcaagcaccggctcatgctgaccttcacagtgacccagaagacgcagaggcgctggttcctcgacaagatagtcgacgagatcggggtgggctacgtccgtgaccgcgggtcggtgtccgactacatcctctcccagatcaagcccctgcacaacttcctcacccagatacagccgttcattaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaactagtggatgaaataggcgtcgggtatatttatgatcagggcagcgtcagtcattataggttgagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 173 - DNA, 1050 bp, artificial sequence
  MHP77(L73-05a)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatgctgatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaaatacaacccttctttaaattaaagcaaaaacaaacaaatttagtgttaaaaataatagaacaattaccgagcgcgaaagaaagtcccgataaatttttagaagtctgtacctgggtggaccaaatagccgcgttaaatgattcaaaaacgaggaaaaccacgagcgaaaccgtcagagccgtgttagatagtttatcagaaaagaagaaaagcagtccg

SEQ ID NO: 174 - DNA, 1047 bp, artificial sequence
  MHP77(L9-01)
atgaacaccaagtacaacaaggagttcctgctctacctggccggcatcgtggacagcgacggctctatcattgcgcagatcaagccggaacagtgctacaagttcaagcaccggctcatgctgaccttcacagtgacccagaagacgagaaggcgctggttcctcgataagctgcatgacgagatcggggtgggctacgtccgtgaccgcgggtcggtgtccgactacatcctctcccagaaaaagcccctgcacaacttcctcacccagctccagccgttcctcaagctgaagcagaagcaggcgaacctcgtcctgaagatcatcgagcagctcccctcggccaaggagtccccggacggtttcctggaggtgtgcacgtgggtcgaccaggttgcggccctcaacgacagcaagacccgcaagacgacctcggagacggtgcgggcggtcctgctgtccctcccaggatcctgggaggtctatcgccatctcaggcatccagcgccgcatcctcggcttcctcaagcccgggttcagggatctccgaagcactcagagctggagcaactaagtccaaagagttttttatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggcagatcaagttgccgcgttaaatgattcaaaaacgaggaaaaccacgagcgaaaccgtcagagccgtgttagatagtttatcagaaaagaagaaaagcagtccg

SEQ ID NO: 175 - DNA, 1050 bp, artificial sequence
  MHP77(L9-02)
atgaacaccaagtacaacaaggagttcctgctctacctggccggcttcgtggacggcgacggctctatcattgcgcagatcaagccggaacagtgctacaagttcaagcaccggctcatgctgaccttcacagtgacccagaagacgagaaggcgctggatcctcgataagctggtagacgagatcggggtgggctacgtccgtgaccgcgggtcggtgtccgactacatcctctcccagaaaaagcccctgcacaacttcctcacccagctccagccgttcctcaagctgaagcagaagcaggcggtcctcgtcctgaagatcatcgagcagctcccctcggccaaggagtccccggacggtttcctggaggtgtgcacgtgggtcgaccaggttgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtatatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggtagatcaaattgccgcgttaaatgattcaaaaacgaggaaaaccacgagcgaaaccgtcagagccgtgttagatagtttatcagaaaagaagaaaagcagtccg

SEQ ID NO: 176 - DNA, 1050 bp, artificial sequence
  MHP77(L9-03)
atgaacaccaagtacaacaaggagttcctgctctacctggccggcttcgtggacagcgacggctctatcattgcgcagatcaagccggaacagtgctacaagttcaagcaccggctcatgctgaccttcacagtgacccagaagacgcaaaggcgctggatcctcttgaagctggtagacgagatcggggtgggctacgtccgtgaccgcgggtcggtgtccgactacatcctctcccagaaaaagcccctgcacaacttcctcacccagctccagccgttcctcaagctgaagcagaagcaggcggtcctcgtcctgaagatcatcgagcagctcccctcggccaaggagtccccggacggtttcctggaggtgtgcacgtgggtcgaccagattgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaacccttcttaaaattaaaacaaaaacaagccaatttagtgttaaaaataatagaacaattaccgagcgcgaaagaaagtcccgataaatttttagaagtctgtacctgggtagatcaagttgccgcgttaaatgattcaaaaacgaggaaaaccacgagcgaaaccgtcagagccgtgttagatagtttatcagaaaagaagaaaagcagtccg

SEQ ID NO: 177 - DNA, 1050 bp, artificial sequence
  MHP77(L9-04)
atgaacaccaagtacaacaaggagttcctgctctacctggccggcttcgtggacggcgacggctgtatcattgcgcagatcaagccggaacagtgctacaagttcaagcaccggctcatgctgaccttcacagtgacccagaagacgcaaaggcgctggatcctcgataagctggtagacgagatcggggtgggctacgtccgtgaccgcgggtcggtgtccgactacatcctctcccagataaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagattgcggccctcaacgacagcaagacccgcaagacgacctcggagacggtgcgggcggtcctggattccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggcagatcaagttgccgcgttaaatgattcaaaaacgaggaaaaccacgagcgaaaccgtcagagccgtgttagatagtttatcagaaaagaagaaaagcagtccg

SEQ ID NO: 178 - DNA, 1050 bp, artificial sequence
  MHP77(L9-06)
atgaacaccaagtacaacaaggagttcctgctctacctggccggcttcgtggacagcgacggctgtatcattgcgcagatcaagccggaacagtgctacaagttcaagcaccggctcatgctgaccttcacagtgacccagaagacgagaaggcgctggatcctcttgaagctggtagacgagatcggggtgggctacgtccgtgaccgcgggtcggtgtccgactacatcctctcccagataaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagattgcggccctcaacgacagcaagacccgcaagacgacctcggagacggtgcgggcggtcctggattccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaacccttcttaaaattaaaacaaaaacaagccaatttagtgttaaaaataatagaacaattaccgagcgcgaaagaaagtcccgatggttttttagaagtctgtacctgggtagatcaagttgccgcgttaaatgattcaaaaacgaggaaaaccacgagcgaaaccgtcagagccgtgttagatagtttatcagaaaagaagaaaagcagtccg

SEQ ID NO: 179 - DNA, 1050 bp, artificial sequence
  MHP77(L9-09)
atgaacaccaagtacaacaaggagttcctgctctacctggccggcatcgtggacagcgacggctgtatcattgcgcagatcaagccggaacagtgctacaagttcaagcaccggctcatgctgaccttcacagtgacccagaagacgagaaggcgctggttcctcgataagctgcatgacgagatcggggtgggctacgtccgtgaccgcgggtcggtgtccgactacatcctctcccagataaagcccctgcacaacttcctcacccagctccagccgttcctcaagctgaagcagaagcaggcggtcctcgtcctgaagatcatcgagcagctcccctcggccaaggagtccccggacaaattcctggaggtgtgcacgtgggtcgaccaggttgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaacccttcttaaaattaaaacaaaaacaagccaatttagtgttaaaaataatagaacaattaccgagcgcgaaagaaagtcccgatggttttttagaagtctgtacctgggtagatcaaattgccgcgttaaatgattcaaaaacgaggaaaaccacgagcgaaaccgtcagagccgtgttagatagtttatcagaaaagaagaaaagcagtccg

SEQ ID NO: 180 - DNA, 1050 bp, artificial sequence
  MHP77(L9-10)
atgaacaccaagtacaacaaggagttcctgctctacctggccggcatcgtggacagcgacggctctatcattgcgcagatcaagccggaacagtgctacaagttcaagcaccggctcatgctgaccttcacagtgacccagaagacgaaaaggcgctggatcctcttgaagctgcatgacgagatcggggtgggctacgtccgtgaccgcgggtcggtgtccgactacatcctctcccagaaaaagcccctgcacaacttcctcacccagctccagccgttcctcaagctgaagcagaagcaggcgaacctcgtcctgaagatcatcgagcagctcccctcggccaaggagtccccggacggtttcctggaggtgtgcacgtgggtcgaccaggttgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaacccttcttaaaattaaaacaaaaacaagccaatttagtgttaaaaataatagaacaattaccgagcgcgaaagaaagtcccgataaatttttagaagtctgtacctgggtagatcaagttgccgcgttaaatgattcaaaaacgaggaaaaccacgagcgaaaccgtcagagccgtgttagatagtttatcagaaaagaagaaaagcagtccg

SEQ ID NO: 181 - DNA, 1050 bp, artificial sequence
  MHP77(L9-11)
atgaacaccaagtacaacaaggagttcctgctctacctggccggcttcgtggacggcgacggctctatcattgcgcagatcaagccggaacagtgctacaagttcaagcaccggctcatgctgaccttcacagtgacccagaagacgaaaaggcgctggttcctcgataagctggtagacgagatcggggtgggctacgtccgtgaccgcgggtcggtgtccgactacatcctctcccagaaaaagcccctgcacaacttcctcacccagctccagccgttcctcaagctgaagcagaagcaggcgaacctcgtcctgaagatcatcgagcagctcccctcggccaaggagtccccggacggtttcctggaggtgtgcacgtgggtcgaccagattgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtatatgatcagggcagcgtcagtcattataggttaagtcaaataaaaccgttacataattttttaacgcaattacaacccttcttaaaattaaaacaaaaacaagccaatttagtgttaaaaataatagaacaattaccgagcgcgaaagaaagtcccgataaatttttagaagtctgtacctgggcagatcaaattgccgcgttaaatgattcaaaaacgaggaaaaccacgagcgaaaccgtcagagccgtgttagatagtttatcagaaaagaagaaaagcagtccg

SEQ ID NO: 182 - DNA, 1050 bp, artificial sequence
  MHP77(L9-12)
atgaacaccaagtacaacaaggagttcctgctctacctggccggcttcgtggacagcgacggctctatcattgcgcagatcaagccggaacagtgctacaagttcaagcaccggctcatgctgaccttcacagtgacccagaagacgcaaaggcgctggatcctcttgaagctggtagacgagatcggggtgggctacgtccgtgaccgcgggtcggtgtccgactacatcctctcccagataaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagattgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgatggttttttagaagtctgtacctgggtagatcaaattgccgcgttaaatgattcaaaaacgaggaaaaccacgagcgaaaccgtcagagccgtgttagatagtttatcagaaaagaagaaaagcagtccg

SEQ ID NO: 183 - DNA, 1050 bp, artificial sequence
  MHP77(L112-03a)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcggaaccgtatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatatagcggggtttgtcgatgctgatgggagcattatagccagtatacgccccgaacaatcgcgtaaatttaaacatcgcttagaattacgttttacggtcacgcaaaagtcactgaggagatggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 184 - DNA, 1050 bp, artificial sequence
  MHP77(L113-01)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcggaaccgcatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttcttgatgctgatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 185 - DNA, 1050 bp, artificial sequence
  MHP77(L13-01a)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccggatcgcggccctcaacgacagcaagacccgcaagacgacctcggagacggtgcgggcggtcctggactctctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 186 - DNA, 1050 bp, artificial sequence
  MHP77(L13-02)
atggacaccaagtacaacaaggagttcctgctctacctggccggcttcgtggacggcgacggctccatcattgcgcagatcaggccggaacagtgctacaagttcaagcaccggctcatgctgaccctcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 187 - DNA, 1050 bp, artificial sequence
  MHP77(L13-04)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 188 - DNA, 1050 bp, artificial sequence
  MHP77(L13-06)
atgaacaccaagtacaacaaggagttcctgctctacctggccggcttcgtggacggcgacggctccatcattgcgcagatcaagccgggacagtgctacaagttcaagcaccggctcatgctgaccttcacagtgacccagaagacgcagaggcgctggttcctcgacaagctggtcgacgagattggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcggctcccctcggccaaggagtccccggacaagttcctggaggtgtgcacgtgggtcgaccagatcgcggccctcaacgacagcaagacccgcaagacgacctcggagacggtgcgggcggccctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaagccgtcagagccgtgttagatagttcatcagaaaagaagaaaagcagtccg

SEQ ID NO: 189 - DNA, 1050 bp, artificial sequence
  MHP77(L13-08a)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcggaggcgctggttcctcgacaagctggccgacgagatcggggtgggctacgtccgtgaccgcgggtcggtgtccgactacatcctctcccagatcaagcccctgcacgacttcctcacccagctccagccgttcctcaagctgaagcagaagcaggcgaacctcgtcctgaagatcatcgagcagctctcctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 190 - DNA, 1050 bp, artificial sequence
  MHP77(L13-10B1)
atgaacaccaagtacaacaaggagttcctgctccacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccagggtccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 191 - DNA, 1050 bp, artificial sequence
  MHP77(L13-11)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctccccccggccaaggagtccccggacaagttcctggaggtgtgcacgtgggtcgaccaggtcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggacgggagcataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 192 - DNA, 1050 bp, artificial sequence
  MHP77(L13-12)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttaggtagtttatcagaaaagaagaaaagcagtccg

SEQ ID NO: 193 - DNA, 1050 bp, artificial sequence
  MHP77(L15-02)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtggggggtctatcgccatctcaggcgtccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttaggtagtttatcagaaaagaagaaaagcagtccg

SEQ ID NO: 194 - DNA, 1050 bp, artificial sequence
  MHP77(L15-03)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggccgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactctctcccagggtccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 195 - DNA, 1050 bp, artificial sequence
  MHP77(L15-05)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagcggcgctggatcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 196 - DNA, 1050 bp, artificial sequence
  MHP77(L15-06)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggccgaccagatcgcggccctcaacgacagcaagacccgcaagacgacctcggagacggtgcgggcggtcctggactccctcccagggtccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagcccg

SEQ ID NO: 197 - DNA, 1050 bp, artificial sequence
  MHP77(L15-08)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccggatcgcggccctcaacgacagcaagacccgcaagacgacctcggagacggtgcgggcggtcctggactccctcccaggatccgtgggaggtctatcgccatctcaggcgtccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgtttgatagtttatcagaaaagaagaaaagcagcccg

SEQ ID NO: 198 - DNA, 1050 bp, artificial sequence
  MHP77(L15-10)
atgaacaccaagtacaacaaggagttcctgctccacctggccggcttcgtggacggcgacggctccatcattgcgcagatcaagccggaacagtgctacaagttcaagcaccggctcatgctgaccttcacagtgacccagaagacgcggaggcgctggttcctcgacaagctggccgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactctctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 199 - DNA, 1050 bp, artificial sequence
  MHP77(L15-11)
atgaacaccaagtacaacaaggagttcctgctctacctggccggcttcgtggacggcgacggctccatcattgcgcagatcaggccggaacagtgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtctatcagaaaagaagaaaagcagtccg

SEQ ID NO: 200 - DNA, 1050 bp, artificial sequence
  MHP77(L15-12)
atgaacaccaagtacaacaaggagttcctgctccacctggccggcttcgtggacggcgacggctccatcatcgcgcagatcaagccggaacagtgctacaagttcaagcaccggctcatgctgaccttcacagtgacccagaagacgcagcggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 201 - DNA, 1050 bp, artificial sequence
  MHP77(L15-13)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggccgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggccgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 202 - DNA, 1050 bp, artificial sequence
  MHP77(L15-15)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctctcctcggccaaggagtccccggacaagttcctgagggtgtgcacgtgggtcgaccagatcgcggccctcaacgacagcaagacccgcaagacgacctcggagacggtgcgggcggtcctggactccctcccagggtccgtgggaggtctatcgccatctcaggcgtccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 203 - DNA, 1050 bp, artificial sequence
  MHP77(L15-16)
atgaacaccaagtacaacaaggagttcctgctctacctggccggcttcgtggacggcgacggctccatcattgcgcagatcaggccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactctctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgtttgatagtttatcagaaaagaagaaaagcagcccg

SEQ ID NO: 204 - DNA, 1050 bp, artificial sequence
  MHP77(L15-18)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacgacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 205 - DNA, 1050 bp, artificial sequence
  MHP77(L15-20)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccagggtccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 206 - DNA, 1050 bp, artificial sequence
  MHP77(L15-21)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggatcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctctcctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 207 - DNA, 1050 bp, artificial sequence
  MHP77(L15-23)
atgaacaccaagtacaacaaggagttcctgctctacctggccggcttcgtggacggcgacggctccatcatcgcgcagatcaagccggaacagtgctacaagttcaagcaccggctcatgctgaccttcacagtgacccagaagacgcagcggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctgagggtgtgcacgtgtgtcgaccggatcgcggccctcaacgacagcaagacccgcaagacgacctcggagacggtgcgggcggtcctggactctctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataattttttaacgcaattacaaccctttttaaaattaaaacaaaaacaagctaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtctatcagaaaagaagaaaagcagtccg

SEQ ID NO: 208 - DNA, 1050 bp, artificial sequence
  MHP77(L15-24)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactctctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttaggtagtttatcagaaaagaagaaaagcagtccg

SEQ ID NO: 209 - DNA, 1050 bp, artificial sequence
  MHP77(L15-28)
atgaacaccaagtacaacaaggagttcctgctccacctggccggcttcgtggacggcgacggctccatcattgcgcagatcaagccggaacagcgctacaagttcaagcaccggctcatgctgaccctcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcggggatgtgtatgatcagggcagcgtcagtcattataggttaagtcgaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 210 - DNA, 1050 bp, artificial sequence
  MHP77(L15-29)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaattggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttaggtagtttatcagaaaagaagaaaagcagtccg

SEQ ID NO: 211 - DNA, 1050 bp, artificial sequence
  MHP77(L15-33)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactctctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagcccg

SEQ ID NO: 212 - DNA, 1050 bp, artificial sequence
  MHP77(L15-34)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctctcctcggccaaggagtccccggacaagttcctggaggtgtgcacgtgggtcgaccggatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 213 - DNA, 1050 bp, artificial sequence
  MHP77(L15-35)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcggaggcgctggttcctcgacaagctggccgacgagatcggggtgggctacgtccgtgaccgcgggtcggtgtccgactacatcctctcccagatcaagcccctgcacgacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccagggtccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagcccg

SEQ ID NO: 214 - DNA, 1050 bp, artificial sequence
  MHP77(L15-36)
atgaacaccaagtacaacaaggagttcctgctccacctggccggcttcgtggacggcgacggctccatcatcgcgcagatcaagccggaacagtgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaggcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttaggtagtttatcagaaaagaagaaaagcagtccg

SEQ ID NO: 215 - DNA, 1050 bp, artificial sequence
  MHP77(L15-39)
atggacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccggatcgcggccctcaacgacagcaagacccgcaagacgacctcggagacggtgcgggcggtcctggactctctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtctatcagaaaagaagaaaagcagtccg

SEQ ID NO: 216 - DNA, 1050 bp, artificial sequence
  MHP77(L15-40)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggatcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 217 - DNA, 1050 bp, artificial sequence
  MHP77(L15-41)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 218 - DNA, 1050 bp, artificial sequence
  MHP77(L15-42)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgtttgatagtttatcagaaaagaagaaaagcagtccg

SEQ ID NO: 219 - DNA, 1050 bp, artificial sequence
  MHP77(L15-43)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagcggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctctcctcggccaaggagtccccggacaagttcctggaggtgtgcacgtgggtcgaccggatcgcggccctcaacgacagcaagacccgcaagacgacctcggagacggtgcgggcggtcctggactccctcccagggtccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 220 - DNA, 1050 bp, artificial sequence
  MHP77(L15-45)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctgagggtgtgcacgtgggtcgaccggatcgcggccctcaacgacagcaagacccgcaagacgacctcggagacggtgcgggcggtcctggactccctcccagggtccgtgggaggtctatcgccatctcaggcgtccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 221 - DNA, 1050 bp, artificial sequence
  MHP77(L15-46)
atgaacaccaagtacaacaaggagttcctgctccacctggccggcttcgtggacggcgacggctccatcatcgcgcagatcaagccggaacagcgctacaagttcaagcaccggctcatgctgaccttcacagtgacccagaagacgcggaggcgctggttcctcgacaagctggtcgacgagatcggggtgggctacgtccgtgaccgcgggtcggtgtccgactacatcctctcccagatcaagcccctgcacgacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgtttgatagtttatcagaaaagaagaaaagcagcccg

SEQ ID NO: 222 - DNA, 1050 bp, artificial sequence
  MHP77(L15-27)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccggatcgcggccctcaacgacagcaagacccgcaagacgacctcggagacggtgcgggcggtcctggactccctcccagggtccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 223 - DNA, 1050 bp, artificial sequence
  MHP77(L15-30)
atgaacaccaagtacaacaaggagttcctgctctacctggccggcttcgtggacggcgacggctccatcattgcgcagatcaggccggaacagtgctacaagttcaagcaccggctcatgctgaccctcacagtgacccagaagacgcagaggcgctggttcctcgacaagctggccgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactctctcccagggtccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagagagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 224 - DNA, 1050 bp, artificial sequence
  MHP77(L15-31)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggatcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagactcgcaagacgacctcggagacggtgcgggcggtcctggactctctcccaggatccgtggggggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtctatcagaaaagaagaaaagcagtccg

SEQ ID NO: 225 - DNA, 1050 bp, artificial sequence
  MHP77(L15-47)
atgaacaccaagtacaacaaggagttcctgctccacctggccggcttcgtggacggcgacggctccatcattgcgcagatcaggccggaacagtgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggaaaagttcctggaggtgtgcacgtgggtcgaccagatcgcggccctcaacgacagcaagacccgcaagacgacctcggagacggtgcgggcggtcctggactccctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 226 - DNA, 1050 bp, artificial sequence
  MHP77(L16-01)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagcggcgctggatcctcttgaagctggtcgacgagatcggggtgggctacgtccgtgaccgcgggtcggtgtccgattacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 227 - DNA, 1050 bp, artificial sequence
  MHP77(L16-02)
atgaacaccaagtacaacaaggagttcctgctctacctggccggcttcgtggacggcgacggctctatcattgcgcagatcaggccggaacagtgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 228 - DNA, 1050 bp, artificial sequence
  MHP77(L16-03)
atgaacaccaagtacaacaaggagttcctgctctacctggccggcttcgtggacagcgacggctctatcattgcgcagatcaagccggaacagcgctacaagttcaagcaccggctcatgctgaccttcacagtgacccagaagacgcagaggcgctggttcctcgacaagctggtagacgagatcggggtgggctacgttcgtgaccgcgggtcggtgtccgactacatcctctcccagataaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagatgaattagtggatgaaataggcgtcgggtatgtgtatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 229 - DNA, 1050 bp, artificial sequence
  MHP77(L16-04)
atgaacaccaagtacaacaaggagttcctgctctacctggccggcttcgtggacggcgacggctctatcattgcgcagatcaggccggaacagcgctacaagttcaagcaccggctcatgctgaccttcacagtgacccagaagacgcggaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 230 - DNA, 1050 bp, artificial sequence
  MHP77(L16-05)
atgaacaccaagtacaacaaggagttcctgctctacctggccggcttcgtagacggcgacggctctatcattgcgcagatcaagccggaacagcgctacaagttcaagcaccggctcatgctgaccttcacagttacccagaagacgagaaggcgctggatcctcgataagctggtagacgagatcggggtgggctacgtccgtgaccgcgggtcggcgtccgactacatcctctcccagaaaaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggacgggagcataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 231 - DNA, 1050 bp, artificial sequence
  MHP77(L16-06)
atgaacaccaagtacaacaaggagttcctgctctacctggccggcttcgtggacggcgacggctctatcattgcgcagatcaagccggaacagtgctacaagttcaagcaccggctcatgctgaccttcacagtgacccagaagacgagaaggcgctggatcctcgataagctggtagacgagatcggggtgggctacgtccgtgaccgcggaaccgcatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggccgaccagatcgcggccctcaacgacagcaagacccgcaagacgacctcggagacggtgcgggcggtcctgctgtccctcccaggatccgtgggaggtctatcgccatctcaggcgtccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 232 - DNA, 1050 bp, artificial sequence
  MHP77(L16-07)
atggacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccggatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 233 - DNA, 1050 bp, artificial sequence
  MHP77(L16-08)
atgaacaccaagtacaacaaggagttcctgctccacctggccggcttcgtggacggcgacggctccatcattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcggaaccgcatccgactacatcctctcccagatcaagcccctgcacgacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagataaattagtggatgagataggcgtcgggtatgtgtatgatcagggcagcgtcagtcattataggttaagtcgaataaaaccgttacataattttttaacgcaattacaaccctttttaaaattaaaacaaaaacaagccaacttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 234 - DNA, 1050 bp, artificial sequence
  MHP77(L16-09)
atgaacaccaagtacaacaaggagttcctgctctacctggccggcttcgtggacgctgatggcagcattattgcgcagatcaagccggaacagtgctacaagttcaagcaccggctcatgctgaccttcacagtgacccagaagacgcaaaggcgctggatcctcttgaagctggtagacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccggatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 235 - DNA, 1050 bp, artificial sequence
  MHP77(L16-11)
atgaacaccaagtacaacaaggagttcctgctctacctggccggcttcgtggacggcgacggctccatcattgcgcagatcaggccggaacagcgctacaagttcaagcaccggctcatgctgaccttcacagtgacccagaagacgcagaggcgctggatcctcgacaagctggtcgacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtatatgatcagggcagcgtcagtcattataggttaagtcgaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 236 - DNA, 1050 bp, artificial sequence
  MHP77(L16-12)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagcggcgctggttcctcgacaagctggtcgacgagatcggggtgggctacgttcgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccaggttgcggccctcaacgacagcaagacccgcaagacgacctcggagacggtgcgggcggtcctggactccctcccagggtccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggacgggagcataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 237 - DNA, 1050 bp, artificial sequence
  MHP77(L16-14)
atgaacaccaagtacaacaaggagttcctgctctacctggccggcttcgtggacggcgacggctccatcattgcgcagatcaggccggaacagcgctacaagttcaagcaccggctcatgctgaccttcacagtgacccagaagacgcggaggcgctggttcctcgacaagctggccgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgctgtccctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggacgggagcataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 238 - DNA, 1050 bp, artificial sequence
  MHP77(L16-15)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggatcctcgacaagctggtcgacgagatcggggtgggctacgtccgtgaccgcgggtcggcgtccgactacatcctctcccagaaaaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagatcgcggccctcaacgacagcaagacccgcaagacgacctcggagacggtgcgggcggtcctggactccctcccaggatccgtgggaggtctatcgccatcccaggcatccagcgccgcatcctcggcttcctcaagcccgggttcaggggtctccgaagcactcagagctggagcaactaagtccaaagagtttttattatatttagcggggtttcttgatgctgatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 239 - DNA, 1050 bp, artificial sequence
  MHP77(L16-16)
atgaacaccaagtacaacaaggagttcctgctctacctggccggcttcgtggacggcgacggctccatcattgcgcagatcaggccggaacagcgctacaagttcaagcaccggctcatgctgaccttcacagtgacccagaagacgcaaaggcgctggatcctcgacaagatagtcgacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaggcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgtttgatagtttatcagaaaagaagaaaagcagcccg

SEQ ID NO: 240 - DNA, 1050 bp, artificial sequence
  MHP77(L16-17)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcaaaggcgctggatcctcttgaagctggtagacgagatcggggtgggctacgtccgtgaccgcggaaccgcatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccaggttgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagatgaattagtggatgaaataggcgtcgggtatgtatatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 241 - DNA, 1050 bp, artificial sequence
  MHP77(L16-18)
atggacaccaagtacaacaaggagttcctgctctacctggccggcttcgtggacggcgacggctccatcattgcgcagatcaagccggaacagcgctacaagttcaagcaccggctcatgctgaccttcacagttacccagaagacgcggaggcgctggttcctcgacaagctggtagacgagatcggggtgggctacgtccgtgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagggtgtgcacgtgggtcgaccggatcgcggccctcaacgacagcaagacccgcaagacgacctcggagacggtgcgggcggtcctggactctctcccaggatccgtgggaggtctatcgccatcccaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagcccg

SEQ ID NO: 242 - DNA, 1050 bp, artificial sequence
  MHP77(L16-19)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgagaaggcgctggatcctcgataagctggtagacgagatcggggtgggctacgtccgtgaccgcgggtcggtgtccgactacatcctctcccagaaaaagcccctgcacaacttcctcacccagctccagccgttcctcaagctgaagcagaagcaggcgaacctcgccctgaagatcatcgagcagctccccccggccaaggagtccccggacaagttcctggaggtgtgcacgtgggtcgaccggatcgcggccctcaacgacagcaagacccgcaagacgacctcggagacggtgcgggcggtcctggactccctcccaggatccgtggggggtctatcgccatcccaggcatccagcgccgcatcctcggcttcctcaagcccgggttcagggatctccgaagcactcagagctggagcaactaagtccaaagagtttttattatatttagcggggtttcttgatgctgatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 243 - DNA, 1050 bp, artificial sequence
  MHP77(L16-21)
atgaacaccaagtacaacaaggagttcctgctctacctggccggcttcgtggacgctgatggcagcattattgcgcagatcaagccggaacagcgctacaagttcaagcaccggctcatgctgaccttcacagtgacccagaagacgcagaggcgctggttcctcgacaagctggtcgacgagatcggggtgggctacgtccgtgaccgcggaaccgcatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccggatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtatacgccccgaacaatcgcgtaaatttaaacatcgcttagaattacgttttacggtcacgcaaaaaacccaacgtaggtggtttttagatgaattagtggatgaaataggcgtcgggtatgtgtatgatcagggcagcgtcagtcattataggttaagtcaaataaaaccgttacataattttttaacgcaattacaaccctacttaaaattaaaacaaaaacaagccaatttagtgttaaaaataatagaacaattaccgagcgcgaaagaaagtcccgataaatttttagaagtctgtacctgggcggatcaaattgccgcgttaaatgattcaaaaacgaggaaaaccacgagcgaaaccgtcagagccgtgtttgatagtttatcagaaaagaagaaaagcagcccg

SEQ ID NO: 244 - DNA, 1050 bp, artificial sequence
  MHP77(L16-23)
atgaacaccaagtacaacaaggagttcctgctctacctggccggcttcgtggacggcgacggctccatcattgcgcagatcaagccggaacagcgctacaagttcaagcaccggctcatgctgaccttcacagtgacccagaagacgcagaggcgctggatcctcgacaagctggtagacgagatcggggtgggctacgtccgtgaccgcgggtcggcgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaaattcctggaggtgtgcacgtgggtcgaccagatcgcggccctcaacgacagcaagacccgcaagacgacctcggagacggtgcgggcggtcctgctgtccctcccaggatccgtggggggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacagtcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataatttcttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtctatcagaaaagaagaaaagcagtccg

SEQ ID NO: 245 - DNA, 1050 bp, artificial sequence
  MHP77(L16-24)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggatcctcgacaagctggtcgacgagatcggggtgggctacgtccgtgaccgcgggtcggtgtccgactacatcctctcccagatcaagcccctgcacaacttcctcacccagctccagccgttcctcaagctgaagcagaagcaggcgaaccttgtcctgaagatcatcgagcagctcccctcggccaaggagtccccggacaagttcctggaggtgtgcacgtgggtcgaccggatcgcggccctcaacgacagcaagacccgcaagacgacctcggagacggtgcgggcggtcctggactctctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcgaataaaaccgttacataattttttaacgcaattacaaccctttttaaaattaaaacaaaaacaagccaacttagtgttaaaaataatagaacaattaccgagcgcgaaagagagtcccgataaatttttagaagtctgtacctgggcggatcaaatagccgcgttaaatgattcaaaaacgaggaaaaccacgagcgaaaccgtcagagccgtgttagatagtctatcagaaaagaagaaaagcagtccg

SEQ ID NO: 246 - DNA, 1050 bp, artificial sequence
  MHP77(L17-12)
atgaacaccaagtacaacaaggagttcctgctctatctagccggcttcgtggacgctgatggcagcttaattgcgcagatcaagccggaacagtgctacaagttcaagcaccggctcatgctgaccttcacagtgacccagaagacgcagaggcgctggttcctcgacaagatagtcgacgagatcggggtgggctacgtccgtgaccgcgggtcggtgtccgactacatcctctcccagatcaagcccctgcacaacttcctcacccagctacagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttgagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 247 - DNA, 1050 bp, artificial sequence
  MHP77(L18-01)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcggaaccgcatccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatctagcggggtttgtcgatgctgatgggagtataatagccagtatacgccccgaacaatcgcgtaaatttaaacatcgcttagaattacgttttacggtcacgcaaaagtcactgaggagatggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 248 - DNA, 1050 bp, artificial sequence
  MHP77(L18-12)
atgaacaccaagtacaacaaggagttcctgctctacctggccggcttcgtggacggcgacggctccatcattgcgcagatcaagccggaacagtgctacaagttcaagcaccggctcatgctgaccttcacagtgacccagaagacgcagaggcgctggttcctcgacaagctggtcgacgagatcggggtgggctacgtccgtgaccgcggaaccgcatccgactacatcctctcccagatcaagcccctgcacaacttcctcacccagctacagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatgctgatgggagtataatagccagtatacgccccgaacaatcgcgtaaatttaaacatcgcttagaattacgttttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaaatacaacccttctttaaattaaagcaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 249 - DNA, 1050 bp, artificial sequence
  MHP77(L17-01)
atgaacaccaagtacaacaaggagttcctgctctacctggccggcttcgtggacgctgatggctccatcattgcgcagatcaagccggaacagtgctacaagttcaagcaccggctcatgctgaccttcacagtgacccagaagacgcagaggcgctggttcctcgacaagatagtcgacgagatcggggtgggctacgttcgtgaccgcgggtcggtgtccgactacatcctctcccagatcaagcccctgcacaacttcctcacccagctacagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtatacgccccgaacaatcgcgtaaatttaaacatcgcttagaattacgttttacggtcacgcaaaaaacccaacgtaggtggtttttagataaactagtggatgaaataggcgtcgggtatatttatgatcagggcagcgtcagtcattataggttgagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 250 - protein, 350 aa, artificial sequence
  MHP77.3
MNTKYNKEFLLYLAGFVDGDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGKVYDQGSVSHYRLCQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 251 - protein, 350 aa, artificial sequence
  MHP77.3(L9-02)
MNTKYNKEFLLYLAGFVDSDGSIIAQIKPEQCYKFKHRLMLTFTVTQKTRRRWILDKLVDEIGVGYVRDRGSVSDYILSQKKPLHNFLTQLQPFLKLKQKQAVLVLKIIEQLPSAKESPDGFLEVCTWVDQVAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGKVYDQGSVSHYRLCQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 252 - protein, 350 aa, artificial sequence
  MHP77.3(L9-11)
MNTKYNKEFLLYLAGFVDGDGSIIAQIKPEQCYKFKHRLMLTFTVTQKTKRRWFLDKLVDEIGVGYVRDRGSVSDYILSQKKPLHNFLTQLQPFLKLKQKQANLVLKIIEQLPSAKESPDGFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGKVYDQGSVSHYRLCQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 253 - protein, 350 aa, artificial sequence
  MHP77.3(L9-12)
MNTKYNKEFLLYLAGFVDSDGSIIAQIKPEQCYKFKHRLMLTFTVTQKTQRRWILLKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLLSLPGSVGGLSPSQASSAASSASSSPGSGISEALRAGATKSKEFLLYLAGFVDGDGSIIASIRPEQSRKFKHRLELRFTVTQKTQRRWFLDELVDEIGVGKVYDQGSVSHYRLCQIKPLHNFLTQLQPYLKLKQKQANLVLKIIEQLPSAKESPDGFLEVCTWVDQIAALNDSKTRKTTSETVRAVLDSLSEKKKSSP

SEQ ID NO: 254 - DNA, 1083 bp, artificial sequence
  MHP77 plant optimized + NLS
atggcaccgaagaagaagcgcaaggtgcatatgaacaccaagtacaacaaggagttcctgctctacctggccggcttcgtggacggcgacggctccatcatcgcgcagatcaagccggagcagtgctacaagttcaagcaccgcctcatgctgaccttcaccgtgacccagaagacgcagaggcgctggttcctcgacaagctggtcgacgagatcggggtgggctacgtccgcgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggctacgtctacgaccaggggtcggtgtcccactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 255 - DNA, 1083 bp, artificial sequence
  MHP77.3 plant optimized + NLS
atggcaccgaagaagaagcgcaaggtgcatatgaacaccaagtacaacaaggagttcctgctctacctggccggcttcgtggacggcgacggctccatcatcgcgcagatcaagccggagcagtgctacaagttcaagcaccgcctcatgctgaccttcaccgtgacccagaagacgcagaggcgctggttcctcgacaagctggtcgacgagatcggggtgggctacgtccgcgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggcgggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggcaaggtctacgaccaggggtcggtgtcccactaccgcctctgccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 256 - DNA, 1272 bp, artificial sequence
  MHP77(L9-02)plant optimized + NLS and ST-LS1 INTRON2
atggcaccgaagaagaagcgcaaggtgcatatgaacaccaagtacaacaaggagttcctgctctacctggccggcttcgtggacagcgacggctccatcatcgcgcagatcaagccggagcagtgctacaagttcaagcaccgcctcatgctgaccttcaccgtgacccagaagacgcgcaggcgctggattctcgacaagctggtcgacgagatcggggtgggctacgtccgcgaccgcgggtcggtgtccgactacatcctctcccagaagaagcccctgcacaacttcctcacccagctgcagccgttcctcaagctgaagcagaagcaggcggtcctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccaggtcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggctacgtctacgaccaggggtcggtgtcccactaccgcctctcccagatcaagcccctgcacaacttcctcacccagctccagccgtacctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 257 - DNA, 1272 bp, artificial sequence
  MHP77(L9-11)plant optimized + NLS and ST-LS1 INTRON2
atggcaccgaagaagaagcgcaaggtgcatatgaacaccaagtacaacaaggagttcctgctctacctggccggcttcgtggacggcgacggctccatcatcgcgcagatcaagccggagcagtgctacaagttcaagcaccgcctcatgctgaccttcaccgtgacccagaagacgaagaggcgctggttcctcgacaagctggtcgacgagatcggggtgggctacgtccgcgaccgcgggtcggtgtccgactacatcctctcccagaagaagcccctgcacaacttcctcacccagctgcagccgttcctcaagctgaagcagaagcaggcgaacctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggctacgtctacgaccaggggtcggtgtcccactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccctga

SEQ ID NO: 258 - DNA, 1272 bp, artificial sequence
  MHP77(L9-12)plant optimized + NLS and ST-LS1 INTRON2
atggcaccgaagaagaagcgcaaggtgcatatgaacaccaagtacaacaaggagttcctgctctacctggccggcttcgtggacagcgacggctccatcatcgcgcagatcaagccggagcagtgctacaagttcaagcaccgcctcatgctgaccttcaccgtgacccagaagacgcagaggcgctggattctcctgaagctggtcgacgagatcggggtgggctacgtccgcgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacgagctggtcgacgagatcggggtgggctacgtctacgaccaggggtcggtgtcccactaccgcctctcccagatcaagcccctgcacaacttcctcacccagctccagccgtacctcaagctgaagcagaagcaggcgaacctcgtcctgaagatcatcgagcagctcccctcggccaaggagtccccggacggattcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 259 - DNA, 1272 bp, artificial sequence
  MHP77.3(L9-02)plant optimized + NLS and ST-LS1 INTRON2
atggcaccgaagaagaagcgcaaggtgcatatgaacaccaagtacaacaaggagttcctgctctacctggccggcttcgtggacagcgacggctccatcatcgcgcagatcaagccggagcagtgctacaagttcaagcaccgcctcatgctgaccttcaccgtgacccagaagacgcgcaggcgctggattctcgacaagctggtcgacgagatcggggtgggctacgtccgcgaccgcgggtcggtgtccgactacatcctctcccagaagaagcccctgcacaacttcctcacccagctgcagccgttcctcaagctgaagcagaagcaggcggtcctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccaggtcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggcaaggtctacgaccaggggtcggtgtcccactaccgcctctgccagatcaagcccctgcacaacttcctcacccagctccagccgtacctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 260 - DNA, 1272 bp, artificial sequence
  MHP77.3(L9-11)plant optimized + NLS and ST-LS1 INTRON2
atggcaccgaagaagaagcgcaaggtgcatatgaacaccaagtacaacaaggagttcctgctctacctggccggcttcgtggacggcgacggctccatcatcgcgcagatcaagccggagcagtgctacaagttcaagcaccgcctcatgctgaccttcaccgtgacccagaagacgaagaggcgctggttcctcgacaagctggtcgacgagatcggggtgggctacgtccgcgaccgcgggtcggtgtccgactacatcctctcccagaagaagcccctgcacaacttcctcacccagctgcagccgttcctcaagctgaagcagaagcaggcgaacctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggcaaggtctacgaccaggggtcggtgtcccactaccgcctctgccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccctga

SEQ ID NO: 261 - DNA, 1272 bp, artificial sequence
  MHP77.3(L9-12)plant optimized + NLS and ST-LS1 INTRON2
atggcaccgaagaagaagcgcaaggtgcatatgaacaccaagtacaacaaggagttcctgctctacctggccggcttcgtggacagcgacggctccatcatcgcgcagatcaagccggagcagtgctacaagttcaagcaccgcctcatgctgaccttcaccgtgacccagaagacgcagaggcgctggattctcctgaagctggtcgacgagatcggggtgggctacgtccgcgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctgctgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatccgcccggagcagtcccgcaagttcaagcaccgcctcgagctgcgcttcaccgtgacccagaagacgcagaggcgctggttcctcgacgagctggtcgacgagatcggggtgggcaaggtctacgaccaggggtcggtgtcccactaccgcctctgccagatcaagcccctgcacaacttcctcacccagctccagccgtacctcaagctgaagcagaagcaggcgaacctcgtcctgaagatcatcgagcagctcccctcggccaaggagtccccggacggattcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 262 - protein, 350 aa, artificial sequence
  MHP77.3(15)
MNTKYNKEFLLYLAGFVDSDGSIIAQIKPEQCYKFKHRLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIRPEQSRKFKHRLELRFTVTQKTQRRWFLDKLVDEIGVGKVYDQGSVSHYRLCQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 263 - DNA, 1272 bp, artificial sequence
  MHP77.3(15)
atggcaccgaagaagaagcgcaaggtgcatatgaacaccaagtacaacaaggagttcctgctctacctggccggcttcgtggacagcgacggctccatcatcgcgcagatcaagccggagcagtgctacaagttcaagcaccgcctcatgctgaccttcaccgtgacccagaagacgcagaggcgctggttcctcgacaagctggtcgacgagatcggggtgggctacgtccgcgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggcgggcttcgtggacggcgacggctccatcatcgcgtccatccgcccggagcagtcccgcaagttcaagcaccgcctcgagctgcgcttcaccgtgacccagaagacgcagaggcgctggttcctcgacaagctggtcgacgagatcggggtgggcaaggtctacgaccaggggtcggtgtcccactaccgcctctgccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 264 - DNA, 1016 bp, artificial sequence
  MHP77HR1
atacataccgccctaaggacctagatagtgtgttggtccaaaaaaccaacatagaaacatcaaagtttttgccattaatagaaaagattgatggacaactcatttccaaagccatacagtcaattgtaatcatcttcaacccaatcaaaaactcatagtttataaccgttctttggccagcttcacggatagtctgtccctctgagactgaaagtagcctagaagtgggtgaataggctaaacctaaaatttccaccacaaactttgaaataatgtcaaataagcagttcaactggtgcaggccagttcaaccgctattaaggccggttgaaccactctaaaccggcccaaccgtgagagaggatcaaggctatgaacaacgcagagactaatgagagattcctttaagaaaagagctcacgggataaattaggcataaatagggaaaatttgtgtggataagatccacacacaagacaactcgatcgatgtcttctttgctaaagataattcacaacgatttgaattaaagcaaagacacaaagacgcaaggatttatcctgaggttcggccacaccataaaggtgccctactccctgttgaggagcccacaaaggaccaagtcttttccaactctaatcctccacaaatcgaccacaaaggtcaaggcaaactctttctcaactttgctcaacgagtgagtgaaacaaacttcttggggtcgtccacaaatttggagactcccaagcaacctcaaactgccaaggaactcgaaggttccaagggcaacaaatctgcacaagaagtgtttgcagtgggctcaagagatgagaaaggggggggagagaaaactaagtctaaaagtgaaaaactcaaactttacaccaagggcccttcaatcaagcgatgagggagcgatttggggtgtgagagagttgggagcttttatctcaagttaggtcagcaatgaatgcgtggagcaaccataatgaatgaggagagagacatgagggggt

SEQ ID NO: 265 - DNA, 898 bp, artificial sequence
  MHP77HR2
ctttggcaagcaattgcatgcgagtaaacaagtaattaagagtaaggttcaccggttaggttccttacctcggtgtaaagcttggaacatggttgttgaggttagttaggttccttacccacaagtcacactctcccacatggtgtgctcatacctaagttatacttgatcagcctagaccacttggcgctcttcacaccccactctactaatgtgctcttcgtgtctcctgtggggcgagcacggtaccccttacaatgcctcctttagagccacacacgatttcatgcaggattccatggagccataacctccaaggcacctaggaggtggaaacctctaaaagtaacaagacaatgatcttcctagtgataacttgataatgtgagttagtaagaggtttggggcgaaggctcaagcatgctcaacaagtgctcctattgctcagcttagggagcacacatttacactcctactttttatagccccacttcccacaactagacactataacactttttgagaaaactacacattagtggacactccataatacaacccacggatagcccatatttgaattccgatgactatatttcaattaaatgcgtgttagtcgtcatagaaagtgtttagtgaacagtctatctgttaatttttaacatgtctataaacttcctaatttatgtccccttttaagaatgtgcgacagatagtctgcctttgaggcccatatagtacaccgaccaaatatttgcattcaccgaaactcccaagtttctatccactatctaaaacagtgtagagacagtctacatgaggggccccaatagtccatcggtcaaaaaacacataaactttaaagtttttgtccatcacttgaattagtatgacatac

SEQ ID NO: 266 - DNA, 22 bp, artificial sequence
  MHP77 target site qPCR probe
actaattcaagtgatggacaaa

SEQ ID NO: 267 - DNA, 23 bp, artificial sequence
  MHP77_forward primer
tccttagggcggtatgtatgtca

SEQ ID NO: 268 - DNA, 26 bp, artificial sequence
  MHP77_reverse primer
catcggtcaaaaaacacataaacttt

SEQ ID NO: 269 - DNA, 22 bp, zea mays
gatggtgacgtacgtgccctac

SEQ ID NO: 270 - protein, 350 aa, artificial sequence
  MS26+
MNTKYNKEFLLYLAGFVDGDGSIIAQIDPQQSYKFKHSLRLRFTVTQKTQRRWFLDKLVDEIGVGKVRDRGSVSDYILCQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSICASIDPNQSCKFKHQLRLRFTVTQKTQRRWFLDKLVDEIGVGKVYDRGSVSDYRLCQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 271 - protein, 350 aa, artificial sequence
  MS26++
MNTKYNKEFLLYLAGFVDGDGSIIAQITPQQSYKFKHALRLRFTVTQKTQRRWFLDKLVDEIGVGKVRDRGSVSDYILSQKKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASITPNQSCKFKHQLRLRFTVTQKTQRRWFLDKLVDEIGVGKVYDRGSVSDYRLSQKKPLHNFLTQLQPFLKLKQKQANLVLKIIEQLPSAKESPDKFLEVCTWVDQIAALNDSKTRKTTSETVRAVLDSLSEKKKSSP

SEQ ID NO: 272 - protein, 350 aa, artificial sequence
  MS26+(7)
MNTKYNKEFLLYLAGIVDGDGSIIAQIDPQQSYKFKHSLRLRFTVTQKTQRRWFLDKLVDEIGVGKVRDRGSVSDYILCQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEGLRAGATKSKEFLLYLAGFVDGDGSICASIDPNQSCKFKHQLRLRFTVTQKTQRRWFLDELVDEIGVGKVYDRGSVSDYRLCQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 273 - protein, 350 aa, artificial sequence
  MS26+(15)
MNTKYNKEFLLYLAGFVDSDGSIIAQIDPQQSYKFKHSLRLRFTVTQKTQRRWFLDKLVDEIGVGKVRDRGSVSDYILCQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSICASIDPNQSCKFKHQLRLRFTVTQKTQRRWFLDKLVDEIGVGKVYDRGSVSDYRLCQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 274 - protein, 350 aa, artificial sequence
  MS26+(B65)
MNTKYNKEFLLYLAGFVDGDGCIIAQIDPQQSYKFKHSLRLRFTVTQKTKRRWFLDKLVDEIGVGKVRDRKSVSDYILCQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSICASIDPNQSCKFKHQLRLRFTVTQKTQRRWFLDKLVDEIGVGKVYDRKSVSDYRLCQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 275 - protein, 350 aa, artificial sequence
  MS26++(15)
MNTKYNKEFLLYLAGFVDSDGSIIAQITPQQSYKFKHALRLRFTVTQKTQRRWFLDKLVDEIGVGKVRDRGSVSDYILSQKKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASITPNQSCKFKHQLRLRFTVTQKTQRRWFLDKLVDEIGVGKVYDRGSVSDYRLSQKKPLHNFLTQLQPFLKLKQKQANLVLKIIEQLPSAKESPDKFLEVCTWVDQIAALNDSKTRKTTSETVRAVLDSLSEKKKSSP

SEQ ID NO: 276 - DNA, 1050 bp, artificial sequence
  MS26+ no intron
atgaacaccaagtacaacaaggagttcctgctctacctggccggcttcgtggacggcgacggctccatcatcgcgcagatcgacccgcagcagtcctacaagttcaagcactccctccgcctgcgcttcaccgtgacccagaagacgcagaggcgctggttcctcgacaagctggtcgacgagatcggggtgggcaaggtccgcgaccgcgggtcggtgtccgactacatcctctgccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggcgggcttcgtggacggcgacggctccatctgcgcgtccatcgacccgaaccagtcctgcaagttcaagcaccagctccgcctgcgcttcaccgtgacccagaagacgcagaggcgctggttcctcgacaagctggtcgacgagatcggggtgggcaaggtctacgaccgcgggtcggtgtccgactaccgcctctgccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 277 - DNA, 1050 bp, artificial sequence
  MS26+(15) no intron
atgaacaccaagtacaacaaggagttcctgctctacctggccggcttcgtggactccgacggctccatcatcgcgcagatcgacccgcagcagtcctacaagttcaagcactccctccgcctgcgcttcaccgtgacccagaagacgcagaggcgctggttcctcgacaagctggtcgacgagatcggggtgggcaaggtccgcgaccgcgggtcggtgtccgactacatcctctgccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggcgggcttcgtggacggcgacggctccatctgcgcgtccatcgacccgaaccagtcctgcaagttcaagcaccagctccgcctgcgcttcaccgtgacccagaagacgcagaggcgctggttcctcgacaagctggtcgacgagatcggggtgggcaaggtctacgaccgcgggtcggtgtccgactaccgcctctgccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 278 - DNA, 1050 bp, artificial sequence
  MS26+(B65) no intron
atgaacaccaagtacaacaaggagttcctgctctacctggccggcttcgtggacggcgacggctgcatcatcgcgcagatcgacccgcagcagtcctacaagttcaagcactccctccgcctgcgcttcaccgtgacccagaagacgaagaggcgctggttcctcgacaagctggtcgacgagatcggggtgggcaaggtccgcgaccgcaagtcggtgtccgactacatcctctgccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggcgggcttcgtggacggcgacggctccatctgcgcgtccatcgacccgaaccagtcctgcaagttcaagcaccagctccgcctgcgcttcaccgtgacccagaagacgcagaggcgctggttcctcgacaagctggtcgacgagatcggggtgggcaaggtctacgaccgcaagtcggtgtccgactaccgcctctgccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 279 - DNA, 1050 bp, artificial sequence
  MS26++ no intron
atgaacaccaagtacaacaaggagttcctcctctacctggcaggtttcgtggacggcgatgggtctatcatcgcccagattaccccgcaacagtcctacaagttcaagcacgccctgcggctgaggttcacggtcactcagaagacgcagcgcaggtggttcctcgataagctggtcgacgaaatcggagtcggcaaggtgcgggacaggggctctgtcagcgactacatcctctcccagaagaagccgctccacaacttcctgacccagctgcagcccttcctcaagctcaagcagaagcaggccaacctggtgctcaagatcatcgagcagctgccatctgccaaggagtcaccagacaagttccttgaggtctgcacctgggtcgatcagatcgctgccctgaacgactccaagacgaggaagaccacctccgagaccgtcagggctgtgctggactcactcccaggatccgttggcggtctcagcccttctcaggctagctcggctgcttcctcagccagcagctcacctggctccggtatcagcgaggctctcagagcaggtgccaccaagtccaaggagttcctcctgtacctggcaggcttcgttgacggcgacggctcgatcatggcgtccattaccccgaaccagtcgtgtaagttcaagcatcagctgcgcctgcgctttaccgtcacgcagaagacccagaggcgctggttcctggacaaactggtggacgagatcggggtcgggaaggtgtacgacagagggagcgttagcgactaccggctgtcccagaagaagccgctccacaacttcctgacgcagctccaacccttcctgaagctgaagcagaagcaggcgaaccttgtgctgaagatcattgagcagctgccgagcgccaaggagagccctgacaagttcctggaggtctgcacctgggtcgaccagatcgctgccctcaacgactccaagaccaggaagaccacgagcgagaccgttcgggctgtcctggacagcctctccgagaagaagaagtcgagcccg

SEQ ID NO: 280 - DNA, 1050 bp, artificial sequence
  MS26++(15) no intron
atgaacaccaagtacaacaaggagttcctcctctacctggcaggtttcgtggactccgatgggtctatcatcgcccagattaccccgcaacagtcctacaagttcaagcacgccctgcggctgaggttcacggtcactcagaagacgcagcgcaggtggttcctcgataagctggtcgacgaaatcggagtcggcaaggtgcgggacaggggctctgtcagcgactacatcctctcccagaagaagccgctccacaacttcctgacccagctgcagcccttcctcaagctcaagcagaagcaggccaacctggtgctcaagatcatcgagcagctgccatctgccaaggagtcaccagacaagttccttgaggtctgcacctgggtcgatcagatcgctgccctgaacgactccaagacgaggaagaccacctccgagaccgtcagggctgtgctggactcactcccaggatccgttggcggtctcagcccttctcaggctagctcggctgcttcctcagccagcagctcacctggctccggtatcagcgaggctctcagagcaggtgccaccaagtccaaggagttcctcctgtacctggcaggcttcgttgacggcgacggctcgatcatggcgtccattaccccgaaccagtcgtgtaagttcaagcatcagctgcgcctgcgctttaccgtcacgcagaagacccagaggcgctggttcctggacaaactggtggacgagatcggggtcgggaaggtgtacgacagagggagcgttagcgactaccggctgtcccagaagaagccgctccacaacttcctgacgcagctccaacccttcctgaagctgaagcagaagcaggcgaaccttgtgctgaagatcattgagcagctgccgagcgccaaggagagccctgacaagttcctggaggtctgcacctgggtcgaccagatcgctgccctcaacgactccaagaccaggaagaccacgagcgagaccgttcgggctgtcctggacagcctctccgagaagaagaagtcgagcccg

SEQ ID NO: 281 - DNA, 22 bp, zea mays
caaacagattcacgtcagattt

SEQ ID NO: 282 - protein, 350 aa, artificial sequence
  MHP14
MNTKYNKEFLLYLAGFVDGDGSIIAQIKPNQSYKFKHQLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 283 - protein, 350 aa, artificial sequence
  MHP14+
MNTKYNKEFLLYLAGFVDSDGSIIAQIKPNQSYKFKHQLMLTFTVTQKTQRRWFLLKLVDEIGVGKVRDRGSVSDYILSQIKPLHNFLTQLQPFLKLKQKQAVLVLKIIEQLPSAKESPDGFLEVCTWVDQVAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDGFLEVCTWADQVAALNDSKTRKTTSETVRAVLDSLSEKKKSSP

SEQ ID NO: 284 - protein, 350 aa, artificial sequence
  MHP14(01)
MNTKYNKEFLLYLAGFVDSDGCIIAQIKPNQSYKFKHQLMLTFTVTQKTQRRWFLLKLVDEIGVGYVRDRGSVSDYILSQKKPLHNFLTQLQPFLKLKQKQAVLVLKIIEQLPSAKESPDGFLEVCTWVDQVAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPYLKLKQKQANLVLKIIEQLPSAKESPDGFLEVCTWVDQVAALNDSKTRKTTSETVRAVLDSLSEKKKSSP

SEQ ID NO: 285 - protein, 350 aa, artificial sequence
  MHP14(02)
MNTKYNKEFLLYLAGIVDSDGCIIAQIKPNQSYKFKHQLMLTFTVTQKTQRRWILDKLHDEIGVGYVRDRGSVSDYILSQIKPLHNFLTQLQPFLKLKQKQAVLVLKIIEQLPSAKESPDKFLEVCTWVDQIAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 286 - protein, 350 aa, artificial sequence
  MHP14(03)
MNTKYNKEFLLYLAGFVDSDGCIIAQIKPNQSYKFKHQLMLTFTVTQKTQRRWILLKLHDEIGVGYVRDRGSVSDYILSQIKPLHNFLTQLQPFLKLKQKQAVLVLKIIEQLPSAKESPDGFLEVCTWVDQVAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDGFLEVCTWADQVAALNDSKTRKTTSETVRAVLDSLSEKKKSSP

SEQ ID NO: 287 - protein, 350 aa, artificial sequence
  MHP14(04)
MNTKYNKEFLLYLAGFVDSDGSIIAQIKPNQSYKFKHQLMLTFTVTQKTQRRWFLLKLVDEIGVGYVRDRGSVSDYILSQIKPLHNFLTQLQPFLKLKQKQAVLVLKIIEQLPSAKESPDGFLEVCTWVDQVAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDGFLEVCTWADQVAALNDSKTRKTTSETVRAVLDSLSEKKKSSP

SEQ ID NO: 288 - protein, 350 aa, artificial sequence
  MHP14(06)
MNTKYNKEFLLYLAGFVDGDGSIIAQIKPNQSYKFKHQLMLTFTVTQKTRRRWFLLKLVDEIGVGYVRDRGSVSDYILSQKKPLHNFLTQLQPFLKLKQKQANLVLKIIEQLPSAKESPDGFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDKFLEVCTWVDQVAALNDSKTRKTTSETVRAVLDSLSEKKKSSP

SEQ ID NO: 289 - protein, 350 aa, artificial sequence
  MHP14(07)
MNTKYNKEFLLYLAGFVDGDGCIIAQIKPNQSYKFKHQLMLTFTVTQKTRRRWILLKLHDEIGVGYVRDRGSVSDYILSQIKPLHNFLTQLQPFLKLKQKQAVLVLKIIEQLPSAKESPDKFLEVCTWVDQVAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 290 - protein, 350 aa, artificial sequence
  290 MHP14(08)
MNTKYNKEFLLYLAGFVDGDGCIIAQIKPNQSYKFKHQLMLTFTVTQKTKRRWILLKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 291 - protein, 350 aa, artificial sequence
  MHP14(09)
MNTKYNKEFLLYLAGFVDSDGCIIAQIKPNQSYKFKHQLMLTFTVTQKTRRRWILLKLVDEIGVGYVRDRGSVSDYILSQIKPLHNFLTQLQPFLKLKQKQAVLVLKIIEQLPSAKESPDGFLEVCTWVDQVAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPFLKLKQKQANLVLKIIEQLPSAKESPDGFLEVCTWVDQIAALNDSKTRKTTSETVRAVLDSLSEKKKSSP

SEQ ID NO: 292 - protein, 349 aa, artificial sequence
  MHP14(10)
MNTKYNKEFLLYLAGIVDGDGCIIAQIKPNQSYKFKHQLMLTFTVTQKTKRRWFLLKLVDEIGVGYVRDRGSVSDYILSQKKPLHNFLTQLQPFLKLKQKQAVLVLKIIEQLPSAKESPDKFLEVCTWVDQVAALNDSKTRKTTSETVRAVLLSLPGSVEVYRHLRHPAPHPRLPQARVQGSPKHSELEPKSKEFLLYLAGFVDGDGSIIAAIKPNQSYKFKHQLSLTFTVTQKTQRRWFLDELVDEIGVGYVRDQGSVSHYQLSQIKPLHNFLTQLQPFLKLKQKQANLVLKIIEQLPSAKESPDKFLEVCTWVDQVAALNDSKTRKTTSETVRAVLDSLSEKKKSSP

SEQ ID NO: 293 - protein, 350 aa, artificial sequence
  MHP14(12)
MNTKYNKEFLLYLAGIVDGDGSIIAQIKPNQSYKFKHQLMLTFTVTQKTKRRWFLDKLVDEIGVGYVRDRGSVSDYILSQIKPLHNFLTQLQPFLKLKQKQAVLVLKIIEQLPSAKESPDKFLEVCTWVDQVAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 294 - protein, 350 aa, artificial sequence
  MHP14(13)
MNTKYNKEFLLYLAGFVDGDGCIIAQIKPNQSYKFKHQLMLTFTVTQKTKRRWILDKLVDEIGVGYVRDRGSVSDYILSQIKPLHNFLTQLQPFLKLKQKQANLVLKIIEQLPSAKESPDGFLEVCTWVDQVAALNDSKTRKTTSETVRAVLLSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDGFLEACTWVDQIAALNDSKTRKTTSETVRAVLDSLSEKKKSSP

SEQ ID NO: 295 - protein, 350 aa, artificial sequence
  MHP14(14)
MNTKYNKEFLLYLAGFVDGDGSIIAQIKPNQSYKFKHQLMLTFTVTQKTRRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQSSVSHYQLSQIKPLHNFLTQLQPFLKLKQKQANLVLKIIEQLPSAKESPDGFLEVCTWADQIAALNDSKTRKTTSETVRAVLDSLSEKKKSSP

SEQ ID NO: 296 - protein, 350 aa, artificial sequence
  MHP14(L14-03)
MNTKYNKEFLLYLAGFVDGDGSIIAQIKPNQSYKFKHQLMLTFTVTQKTQRRWFLDKLVDEVGVGYVRDRGSVSDYILSQIKPLHNFLTQLQPFLKLRQKQANLALKIIEQLPSARETPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 297 - protein, 350 aa, artificial sequence
  MHP14(L14-04)
MNTKYNKEFLLYLAGFVDGDGSIIAQIKPNRSYKFKHQLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 298 - protein, 350 aa, artificial sequence
  MHP14(L14-07)
MNTKYNKEFLLHLAGFVDGDGSIIAQIKPNQSYKFKHQLMLTFTVTQKTQRRWFLDKLVDEIGVGYVRDRGSVSDYILSQIKPLHNFLTQLQPFLKLKQKQANLVLKIIEQLPSAKESPDKFLEVCTWVDQTAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 299 - DNA, 1050 bp, artificial sequence
  MHP14 yeast
atgaacaccaagtacaacaaggagttcctgctctacctggccggcttcgtggacggcgacggctccatcatagcgcagatcaagccgaaccagtcctacaagttcaagcaccagctcatgctgaccttcacggtgacccagaagacgcagaggcgctggttcctcgacaagctggtcgacgagatcggggtgggctacgtccgtgaccgcgggtcggtgtccgactacatactctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataaattagtggatgaaataggcgtcgggtatgtgcgtgatcagggcagcgtcagtcattatcagttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 300 - DNA, 1050 bp, artificial sequence
  MHP14(01)
atgaacaccaagtacaacaaggagttcctgctctacctggccggctttgtggacagcgacggctgcatcatagcgcagatcaagccgaaccagtcctacaagttcaagcaccagctcatgctgaccttcacggtgacccagaagacgcagaggcgctggtttctcctaaagctggtagacgagatcggggtgggctacgtccgtgaccgcgggtcggtgtccgactacatactctcccagaaaaagcccctgcacaacttcctcacccagctccagccgttcctcaagctgaagcagaagcaggcggtcctcgtcctgaagatcatcgagcagctcccctcggccaaggagtccccggacggattcctggaggtgtgcacgtgggtcgaccaggttgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgatggatttttagaagtctgtacctgggtggatcaagttgccgcgttaaatgattcaaaaacgaggaaaaccacgagcgaaaccgtcagagccgtgttagatagtttatcagaaaagaagaaaagcagtccg

SEQ ID NO: 301 - DNA, 1050 bp, artificial sequence
  MHP14(02)
atgaacaccaagtacaacaaggagttcctgctctacctggccggcattgtggacagcgacggctgcatcatagcgcagatcaagccgaaccagtcctacaagttcaagcaccagctcatgctgaccttcacggtgacccagaagacgcagaggcgctggattctcgataagctgcacgacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacaagttcctggaggtgtgcacgtgggtcgaccagattgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgataagtttttagaagtctgtacctgggtggatcaaattgccgcgttaaatgattcaaaaacgaggaaaaccacgagcgaaaccgtcagagccgtgttagatagtttatcagaaaagaagaaaagcagtccg

SEQ ID NO: 302 - DNA, 1050 bp, artificial sequence
  MHP14(03
atgaacaccaagtacaacaaggagttcctgctctacctggccggctttgtggacagcgacggctgcatcatagcgcagatcaagccgaaccagtcctacaagttcaagcaccagctcatgctgaccttcacggtgacccagaagacgcagaggcgctggattctcctaaagctgcacgacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacggattcctggaggtgtgcacgtgggtcgaccaggttgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgatggatttttagaagtctgtacctgggcggatcaagttgccgcgttaaatgattcaaaaacgaggaaaaccacgagcgaaaccgtcagagccgtgttagatagtttatcagaaaagaagaaaagcagtccg

SEQ ID NO: 303 - DNA, 1050 bp, artificial sequence
  MHP14(04)
atgaacaccaagtacaacaaggagttcctgctctacctggccggctttgtggacagcgacggcagcatcatagcgcagatcaagccgaaccagtcctacaagttcaagcaccagctcatgctgaccttcacggtgacccagaagacgcagaggcgctggtttctcctaaagctggtagacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacggattcctggaggtgtgcacgtgggtcgaccaggttgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataagttagtggatgaaataggcgtcgggtatgtacgtgatcagggcagcgtcagtcattatcagttaagtcaaataaaaccgttacataattttttaacgcaattacaacccttcttaaaattaaaacaaaaacaagccaatttagtgttaaaaataatagaacaattaccgagcgcgaaagaaagtcccgatggatttttagaagtctgtacctgggcggatcaagttgccgcgttaaatgattcaaaaacgaggaaaaccacgagcgaaaccgtcagagccgtgttagatagtttatcagaaaagaagaaaagcagtccg

SEQ ID NO: 304 - DNA, 1050 bp, artificial sequence
  MHP14(06)
atgaacaccaagtacaacaaggagttcctgctctacctggccggctttgtggacggcgacggcagcatcatagcgcagatcaagccgaaccagtcctacaagttcaagcaccagctcatgctgaccttcacggtgacccagaagacgcgtaggcgctggtttctcctaaagctggtagacgagatcggggtgggctacgtccgtgaccgcgggtcggtgtccgactacatactctcccagaaaaagcccctgcacaacttcctcacccagctccagccgttcctcaagctgaagcagaagcaggcgaatctcgtcctgaagatcatcgagcagctcccctcggccaaggagtccccggacggattcctggaggtgtgcacgtgggtcgaccagattgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgataagtttttagaagtctgtacctgggtggatcaagttgccgcgttaaatgattcaaaaacgaggaaaaccacgagcgaaaccgtcagagccgtgttagatagtttatcagaaaagaagaaaagcagtccg

SEQ ID NO: 305 - DNA, 1050 bp, artificial sequence
  MHP14(07)
atgaacaccaagtacaacaaggagttcctgctctacctggccggctttgtggacggcgacggctgcatcatagcgcagatcaagccgaaccagtcctacaagttcaagcaccagctcatgctgaccttcacggtgacccagaagacgcgtaggcgctggattctcctaaagctgcacgacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacaagttcctggaggtgtgcacgtgggtcgaccaggttgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgataagtttttagaagtctgtacctgggtggatcaaattgccgcgttaaatgattcaaaaacgaggaaaaccacgagcgaaaccgtcagagccgtgttagatagtttatcagaaaagaagaaaagcagtccg

SEQ ID NO: 306 - DNA, 1050 bp, artificial sequence
  MHP14(08)
atgaacaccaagtacaacaaggagttcctgctctacctggccggctttgtggacggcgacggctgcatcatagcgcagatcaagccgaaccagtcctacaagttcaagcaccagctcatgctgaccttcacggtgacccagaagacgaagaggcgctggattctcctaaagctggtagacgagatcggggtgggctacgtccgtgaccgcgggtcggtgtccgactacatactctcccagataaagcccctgcacaacttcctcacccagctccagccgttcctcaagctgaagcagaagcaggcgaatctcgtcctgaagatcatcgagcagctcccctcggccaaggagtccccggacaagttcctggaggtgtgcacgtgggtcgaccagattgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctctgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataagttagtggatgaaataggcgtcgggtatgtacgtgatcagggcagcgtcagtcattatcagttaagtcaaataaaaccgttacataattttttaacgcaattacaacccttcttaaaattaaaacaaaaacaagccaatttagtgttaaaaataatagaacaattaccgagcgcgaaagaaagtcccgataagtttttagaagtctgtacctgggcggatcaaattgccgcgttaaatgattcaaaaacgaggaaaaccacgagcgaaaccgtcagagccgtgttagatagtttatcagaaaagaagaaaagcagtccg

SEQ ID NO: 307 - DNA, 1050 bp, artificial sequence
  MHP14(09)
atgaacaccaagtacaacaaggagttcctgctctacctggccggctttgtggacagcgacggctgcatcatagcgcagatcaagccgaaccagtcctacaagttcaagcaccagctcatgctgaccttcacggtgacccagaagacgcgtaggcgctggattctcctaaagctggtagacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacggattcctggaggtgtgcacgtgggtcgaccaggttgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaacccttcttaaaattaaaacaaaaacaagccaatttagtgttaaaaataatagaacaattaccgagcgcgaaagaaagtcccgatggatttttagaagtctgtacctgggtggatcaaattgccgcgttaaatgattcaaaaacgaggaaaaccacgagcgaaaccgtcagagccgtgttagatagtttatcagaaaagaagaaaagcagtccg

SEQ ID NO: 308 - DNA, 1047 bp, artificial sequence
  MHP14(10)
atgaacaccaagtacaacaaggagttcctgctctacctggccggcattgtggacggcgacggctgcatcatagcgcagatcaagccgaaccagtcctacaagttcaagcaccagctcatgctgaccttcacggtgacccagaagacgaagaggcgctggtttctcctaaagctggtagacgagatcggggtgggctacgtccgtgaccgcgggtcggtgtccgactacatactctcccagaaaaagcccctgcacaacttcctcacccagctccagccgttcctcaagctgaagcagaagcaggcggtcctcgtcctgaagatcatcgagcagctcccctcggccaaggagtccccggacaagttcctggaggtgtgcacgtgggtcgaccaggttgcggccctcaacgacagcaagacccgcaagacgacctcggagacggtgcgggcggtcctgttgtccctcccaggatccgtggaggtctatcgccatctcaggcatccagcgccgcatcctcggcttcctcaagcccgggttcagggatctccgaagcactcagagctggagcctaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaacccttcttaaaattaaaacaaaaacaagccaatttagtgttaaaaataatagaacaattaccgagcgcgaaagaaagtcccgataagtttttagaagtctgtacctgggtggatcaagttgccgcgttaaatgattcaaaaacgaggaaaaccacgagcgaaaccgtcagagccgtgttagatagtttatcagaaaagaagaaaagcagtccg

SEQ ID NO: 309 - DNA, 1050 bp, artificial sequence
  MHP14(12)
atgaacaccaagtacaacaaggagttcctgctctacctggccggcattgtggacggcgacggcagcatcatagcgcagatcaagccgaaccagtcctacaagttcaagcaccagctcatgctgaccttcacggtgacccagaagacgaagaggcgctggtttctcgataagctggtagacgagatcggggtgggctacgtccgtgaccgcgggtcggtgtccgactacatactctcccagataaagcccctgcacaacttcctcacccagctccagccgttcctcaagctgaagcagaagcaggcggtcctcgtcctgaagatcatcgagcagctcccctcggccaaggagtccccggacaagttcctggaggtgtgcacgtgggtcgaccaggttgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgataagtttttagaagtctgtacctgggtggatcaaattgccgcgttaaatgattcaaaaacgaggaaaaccacgagcgaaaccgtcagagccgtgttagatagtttatcagaaaagaagaaaagcagtccg

SEQ ID NO: 310 - DNA, 1050 bp, artificial sequence
  MHP14(13)
atgaacaccaagtacaacaaggagttcctgctctacctggccggctttgtggacggcgacggctgcatcatagcgcagatcaagccgaaccagtcctacaagttcaagcaccagctcatgctgaccttcacggtgacccagaagacgaagaggcgctggattctcgataagctggtagacgagatcggggtgggctacgtccgtgaccgcgggtcggtgtccgactacatactctcccagataaagcccctgcacaacttcctcacccagctccagccgttcctcaagctgaagcagaagcaggcgaatctcgtcctgaagatcatcgagcagctcccctcggccaaggagtccccggacggattcctggaggtgtgcacgtgggtcgaccaggttgcggccctcaacgacagcaagacccgcaagacgacctcggagacggtgcgggcggtcctgttgtccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagatgagttagtggatgaaataggcgtcgggtatgtacgtgatcagggcagcgtcagtcattatcagttaagtcaaataaaaccgttacataattttttaacgcaattacaaccctacttaaaattaaaacaaaaacaagccaatttagtgttaaaaataatagaacaattaccgagcgcgaaagaaagtcccgatggatttttagaagcctgtacctgggtggatcaaattgccgcgttaaatgattcaaaaacgaggaaaaccacgagcgaaaccgtcagagccgtgttagatagtttatcagaaaagaagaaaagcagtccg

SEQ ID NO: 311 - DNA, 1050 bp, artificial sequence
  MHP14(14)
atgaacaccaagtacaacaaggagttcctgctctacctggccggctttgtggacggcgacggcagcatcatagcgcagatcaagccgaaccagtcctacaagttcaagcaccagctcatgctgaccttcacggtgacccagaagacgcgtaggcgctggtttctcgataagctggtagacgagatcggggtgggctacgtccgtgaccgcgggtcggtgtccgactacatactctcccagataaagcccctgcacaacttcctcacccagctccagccgttcctcaagctgaagcagaagcaggcgaatctcgtcctgaagatcatcgagcagctcccctcggccaaggagtccccggacaagttcctggaggtgtgcacgtgggtcgaccagattgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataagttagtggatgaaataggcgtcgggtatgtacgtgatcagagcagcgtcagtcattatcagttaagtcaaataaaaccgttacataattttttaacgcaattacaacccttcttaaaattaaaacaaaaacaagccaatttagtgttaaaaataatagaacaattaccgagcgcgaaagaaagtcccgatggatttttagaagtctgtacctgggcggatcaaattgccgcgttaaatgattcaaaaacgaggaaaaccacgagcgaaaccgtcagagccgtgttagatagtttatcagaaaagaagaaaagcagtccg

SEQ ID NO: 312 - DNA, 1050 bp, artificial sequence
  MHP14(L14-03)
atgaacaccaagtacaacaaggagttcctgctctacctggccggcttcgtggacggcgacggctccatcatagcgcagatcaagccgaaccagtcctacaagttcaagcaccagctcatgctgaccttcacggtgacccagaagacgcagaggcgctggttcctcgacaagctggtcgacgaggttggggtgggctacgtccgtgaccgcgggtcggtgtccgactacatactctcccagatcaagcccctgcacaacttcctcacccagctccagccgttcctcaagctgaggcagaagcaggcgaacctcgccctgaagatcatcgagcagctcccctcggccagggagaccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatctagcggggtttgtcgatggggatgggagtataatagccgctataaaacccaatcaatcttataaatttaaacatcaattaagtttaacatttacggtcacgcaaaaaacccaacgtaggtggtttttagataaattagtggatgaaataggcgtcgggtatgtgcgtgatcagggcagcgtcagtcattatcagttaagccaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 313 - DNA, 1050 bp, artificial sequence
  MHP14(L14-04)
atgaacaccaagtacaacaaggagttcctgctctacctggccggcttcgtggacggcgacggctccatcatagcgcagatcaagccgaaccggtcctacaagttcaagcaccagctcatgctgaccttcacggtgacccagaagacgcagaggcgctggttcctcgacaagctggtcgacgagatcggggtgggctacgtccgtgaccgcgggtcggtgtccgactacatactctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataaattagtggatgaaataggcgtcgggtatgtgcgtgatcagggcagcgtcagtcattatcagttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 314 - DNA, 1050 bp, artificial sequence
  MHP14(L14-07)
atgaacaccaagtacaacaaggagttcctgctccacctggccggcttcgtggacggcgacggctccatcatagcgcagatcaagccgaaccagtcctacaagttcaagcaccagctcatgctgaccttcacggtgacccagaagacgcagaggcgctggttcctcgacaagctggtcgacgagatcggggtgggctacgtccgtgaccgcgggtcggtgtccgactacatactctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagaccgcggccctcaacgacagcaagacccgcaagacgacctcggagacggtgcgggcggtcctggactccctcccgggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccgctataaaacccaatcaatcttataaatttaaacatcaattaagtttaacatttacggtcacgcaaaaaacccaacgtaggtggtttttagataaattagtggatgaaataggcgtcgggtatgtgcgtgatcagggcagcgtcagtcattatcagttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagacagtttatcagaaaagaagaaaagcagtccg

SEQ ID NO: 315 - protein, 350 aa, artificial sequence; identical to SEQ ID NO: 283
  MHP14+(04)

SEQ ID NO: 316 - protein, 350 aa, artificial sequence
  MHP14+(06)
MNTKYNKEFLLYLAGFVDGDGSIIAQIKPNQSYKFKHQLMLTFTVTQKTRRRWFLLKLVDEIGVGKVRDRGSVSDYILSQKKPLHNFLTQLQPFLKLKQKQANLVLKIIEQLPSAKESPDGFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDKFLEVCTWVDQVAALNDSKTRKTTSETVRAVLDSLSEKKKSSP

SEQ ID NO: 317 - protein, 350 aa, artificial sequence
  MHP14+(08)
MNTKYNKEFLLYLAGFVDGDGCIIAQIKPNQSYKFKHQLMLTFTVTQKTKRRWILLKLVDEIGVGKVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 318 - protein, 350 aa, artificial sequence
  MHP14+(12)
MNTKYNKEFLLYLAGIVDGDGSIIAQIKPNQSYKFKHQLMLTFTVTQKTKRRWFLDKLVDEIGVGKVRDRGSVSDYILSQIKPLHNFLTQLQPFLKLKQKQAVLVLKIIEQLPSAKESPDKFLEVCTWVDQVAALNDSKTRKTTSETVRAVLMSLPGSVGGLSPSQASSAASSASSSPGSGISEALRAGATKSKEFLLYLAGFVDGDGSIIAAIKPNQSYKFKHQLSLTFTVTQKTQRRWFLDELVDEIGVGYVRDQGSVSHYQLSQIKPLHNFLTQLQPYLKLKQKQANLVLKIIEQLPSAKESPDKFLEVCTWVDQIAALNDSKTRKTTSETVRAVLDSLSEKKKSSP

SEQ ID NO: 319 - protein, 350 aa, artificial sequence
  MHP14+(14)
MNTKYNKEFLLYLAGFVDGDGSIIAQIKPNQSYKFKHQLMLTFTVTQKTRRRWFLDKLVDEIGVGKVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQSSVSHYQLSQIKPLHNFLTQLQPFLKLKQKQANLVLKIIEQLPSAKESPDGFLEVCTWADQIAALNDSKTRKTTSETVRAVLDSLSEKKKSSP

SEQ ID NO: 320 - protein, 350 aa, artificial sequence
  MHP14+(15)
MNTKYNKEFLLYLAGFVDSDGSIIAQIKPNQSYKFKHQLMLTFTVTQKTQRRWFLDKLVDEIGVGKVRDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAAIKPNQSYKFKHQLSLTFTVTQKTQRRWFLDKLVDEIGVGYVRDQGSVSHYQLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 321 - DNA, 1239 bp, artificial sequence
  MHP14 (with intron) maize
atgaacaccaagtacaacaaggagttcctgctctacctggccggcttcgtggacggcgacggctccatcatcgcgcagatcaagccgaaccagtcctacaagttcaagcaccagctcatgctgaccttcaccgtgacccagaagacgcagaggcgctggttcctcgacaagctggtcgacgagatcggggtgggctacgtccgcgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacaagctggtcgacgagatcggggtgggctacgtccgcgaccaggggtcggtgtcccactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 322 - DNA, 1239 bp, artificial sequence
  MHP14+(04) (with intron) maize
atgaacaccaagtacaacaaggagttcctgctctacctggccggcttcgtggacagcgacggctccatcatcgcgcagatcaagccgaaccagtcctacaagttcaagcaccagctcatgctgaccttcaccgtgacccagaagacgcagaggcgctggttcctcctcaagctggtcgacgagatcggggtgggcaaggtccgcgaccgcgggtcggtgtccgactacatcctctcccagatcaagcccctgcacaacttcctcacccagctgcagccgttcctcaagctgaagcagaagcaggcggtgctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccaggtcgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacaagctggtcgacgagatcggggtgggctacgtccgcgaccaggggtcggtgtcccactaccagctctcccagatcaagcccctgcacaacttcctcacccagctccagccgttcctcaagctgaagcagaagcaggcgaacctcgtcctgaagatcatcgagcagctcccctcggccaaggagtccccggacgggttcctggaggtgtgcacgtgggctgaccaggtcgcggccctcaacgacagcaagacccgcaagacgacctcggagacggtgcgggcggttctagactccctcagcgagaagaagaagtcgtccccc

SEQ ID NO: 323 - DNA, 1239 bp, artificial sequence
  MHP14+(06) (with intron) maize
atgaacaccaagtacaacaaggagttcctgctctacctggccggcttcgtggacggcgacggctccatcatcgcgcagatcaagccgaaccagtcctacaagttcaagcaccagctcatgctgaccttcaccgtgacccagaagacgaggaggcgctggttcctcctcaagctggtcgacgagatcggggtgggcaaggtccgcgaccgcgggtcggtgtccgactacatcctctcccagaagaagcccctgcacaacttcctcacccagctgcagccgttcctcaagctgaagcagaagcaggcgaacctcgtcctgaagatcatcgagcagctcccctcggccaaggagtccccggacggcttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacgagctggtcgacgagatcggggtgggctacgtccgcgaccaggggtcggtgtcccactaccagctctcccagatcaagcccctgcacaacttcctcacccagctccagccgtacctcaagctgaagcagaagcaggcgaacctcgtcctgaagatcatcgagcagctcccctcggccaaggagtccccggacaagttcctggaggtgtgcacgtgggtcgaccaggtcgcggccctcaacgacagcaagacccgcaagacgacctcggagacggtgcgggcggttctagactccctcagcgagaagaagaagtcgtccccc

SEQ ID NO: 324 - DNA, 1239 bp, artificial sequence
  MHP14+(08) (with intron) maize
atgaacaccaagtacaacaaggagttcctgctctacctggccggcttcgtggacggcgacggctgcatcatcgcgcagatcaagccgaaccagtcctacaagttcaagcaccagctcatgctgaccttcaccgtgacccagaagacgaagaggcgctggattctcctcaagctggtcgacgagatcggggtgggcaaggtccgcgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacaagctggtcgacgagatcggggtgggctacgtccgcgaccaggggtcggtgtcccactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccc

SEQ ID NO: 325 - DNA, 1239 bp, artificial sequence
  MHP14+(12) (with intron) maize
atgaacaccaagtacaacaaggagttcctgctctacctggccggcatcgtggacggcgacggctccatcatcgcgcagatcaagccgaaccagtcctacaagttcaagcaccagctcatgctgaccttcaccgtgacccagaagacgaagaggcgctggttcctcgacaagctggtcgacgagatcggggtgggcaaggtccgcgaccgcgggtcggtgtccgactacatcctctcccagatcaagcccctgcacaacttcctcacccagctgcagccgttcctcaagctgaagcagaagcaggcggtgctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccaggtcgcggccctcaacgacagcaagacccgcaagacgacctcggagacggtgcgggcggtcctgatgtccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacgagctggtcgacgagatcggggtgggctacgtccgcgaccaggggtcggtgtcccactaccagctctcccagatcaagcccctgcacaacttcctcacccagctccagccgtacctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 326 - DNA, 1239 bp, artificial sequence
  MHP14+(14) (with intron) maize
atgaacaccaagtacaacaaggagttcctgctctacctggccggcttcgtggacggcgacggctccatcatcgcgcagatcaagccgaaccagtcctacaagttcaagcaccagctcatgctgaccttcaccgtgacccagaagacgaggaggcgctggttcctcgacaagctggtcgacgagatcggggtgggcaaggtccgcgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacaagctggtcgacgagatcggggtgggctacgtccgcgaccagtcgtcggtgtcccactaccagctctcccagatcaagcccctgcacaacttcctcacccagctccagccgttcctcaagctgaagcagaagcaggcgaacctcgtcctgaagatcatcgagcagctcccctcggccaaggagtccccggacgggttcctggaggtgtgcacgtgggccgaccagatcgcggccctcaacgacagcaagacccgcaagacgacctcggagacggtgcgggcggttctagactccctcagcgagaagaagaagtcgtccccc

SEQ ID NO: 327 - DNA, 1239 bp, artificial sequence
  MHP14+(15) (with intron) maize
atgaacaccaagtacaacaaggagttcctgctctacctggccggcttcgtggacagcgacggctccatcatagcgcagatcaagccgaaccagtcctacaagttcaagcaccagctcatgctgaccttcacggtgacccagaagacgcagaggcgctggttcctcgacaagctggtcgacgagatcggggtgggcaaggtccgtgaccgcgggtcggtgtccgactacatcctctcccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcggcgatcaagccgaaccagtcctacaagttcaagcaccagctctccctgaccttcaccgtgacccagaagacgcagaggcgctggttcctcgacaagctggtcgacgagatcggggtgggctacgtccgcgaccaggggtcggtgtcccactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccc

SEQ ID NO: 328 - DNA, 22 bp, zea mays
ctagtatacgtgagagaccttg

SEQ ID NO: 329 - protein, 350 aa, artificial sequence
  MHP107
MNTKYNKEFLLYLAGFVDGDGSIIAAISPNQSCKFKHQLRLTFTVTQKTQRRWFLDKLVDEIGVGKVYDRGSVSDYQLSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 330 - protein, 350 aa, artificial sequence
  MHP107(C1)
MNTKYNKEFLLYLAGFVDGDGSIIAAISPNQSCKFKHQLRLTFTVTQKTRRRWILDKLVDEIGVGKVYDRGSVSDYQLSQIKPLHNFLTQLQPFLKLKQKQANLALKIIEQLPSAKESPDKFLEVCTWVDQIAALNDSKTRKTTSETVRAVLLSLPGSVGGLSPSQASSAASSASSSPGSGISETLRAGATKSKEFLLYLAGFVDGDGSIKAQIDPNQSYKFKHQLRLRFQVTQKTQRRWILDKLVDEIGVGHVYDRGSVSDYILSQIKPLHNFLTQLQPFLKLKQKQANLVLKIIEQLPSAKESPDKFLEVCTWADRIAALNDSKTRKTTSETVRAVLDSLSEKKKSSP

SEQ ID NO: 331 - protein, 350 aa, artificial sequence
  MHP107(C2)
MNTKYNKEFLLYLAGFVDGDGSIIAAISPNQSCKFKHQLRLTFTVTQKTQRRWFLDKLVDEIGVGKVYDRGSVSDYQLSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 332 - protein, 350 aa, artificial sequence
  MHP107(C3)
MNTKYNKEFLLYLAGFVDGDGSIIAAISPNQRCKFKHQLRLTFTVTQKTRRRWFLDELVDEIGVGKVYDRGSVSDYQLSQIKPLHNFLTQLQPFLKLKQKQANLVLKIIEQLPSAKESPDKFLRVCTWVDQIAALNDSKTRKTTSETVRAVLLSLPGSVGGLSPSQASSAASSASSSPGSGISEALRAGATKSKEFLLYLAGFVDGDGSIMAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 333 - protein, 350 aa, artificial sequence
  MHP107(C4)
MNTKYNKEFLLYLAGFVDGDGSIIAAISPNQSCKFKHQLRLTFTVTQKTRRRWFLDKLVDEIGVGKVYDRGSVSDYQLSRIKPLHNFLTQLQPFLKLKQKQANLVLKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 334 - protein, 350 aa, artificial sequence
  MHP107(C5)
MNTKYNKEFLLYLAGFVDGDGSIIAAISPNQSCKFKHQLRLTFTVTQKTRRRWILDELVDEIGVGKVYDRGSVSDYQLSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 335 - protein, 350 aa, artificial sequence
  MHP107(C6)
MNTKYNKEFLLYLAGFVDGDGSIIAAISPNQSCKFKHQLRLTFTVTQKTRRRWILDKLVDEIGVGKVYDRGSVSDYQLSQIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWILDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 336 - protein, 350 aa, artificial sequence
  MHP107(D2)
MNTKYNKEFLLYLAGFVDGDGSIIAAISPNQSCKFKHQLRLTFTVTQKTRRRWILLKLVDEIGVGKVYDRGSVSDYQLSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWADRIAALNDSKTRKTTSETVRAVLLSLSEKKKSSP

SEQ ID NO: 337 - protein, 350 aa, artificial sequence
  MHP107(D3)
MNTKYNKEFLLHLAGFVDGDGSIMAAISPNQSCKFKHQLRLTFTVTQKTQRRWFLDKLVDEIGVGKVYDRGSVSDYQLSRIKPLHNFLTQLQPFLKLKQKQANLALKIIEQLPSAKESPDKFLRVCTWADQIAALNDSKTRKTTSETVRAVLLSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLALKIIEQLPSAKESPDKFLEVCTWADRIAALNDSKTRKTTSETVRAVLDSLSEKKKSSP

SEQ ID NO: 338 - protein, 350 aa, artificial sequence
  MHP107(D4)
MNTKYNKEFLLHLAGFVDGDGSIIAAISPNQSCKFKHQLRLTFTVTQKTRRRWFLDKLVDEIGVGKVYDRGSVSDYQLSQIKPLHNFLTQLQPFLKLKQKQANLALKIIEQLPSAKESPDKFLEVCTWADQIAALNDSKTRKTTSETVRAVLLSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 339 - protein, 350 aa, artificial sequence
  MHP107(D5)
MNTKYNKEFLLHLAGFVDGDGSIMAAISPNQSCKFKHQLRLTFTVTQKTRRRWILDELVDEIGVGKVYDRGSVSDYQLSQIKPLHNFLTQLQPFLKLKQKQANLALKIIEQLPSAKESPDKFLRVCTWADQIAALNDSKTRKTTSETVRAVLLSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLALKIIEQLPSAKESPDKFLRVCTWVDQIAALNDSKTRKTTSETVRAVLDSLSEKKKSSP

SEQ ID NO: 340 - protein, 350 aa, artificial sequence
  MHP107(D1)
MNTKYNKEFLLHLAGFVDGDGSIMAAISPNQSCKFKHQLRLTFTVTQKTQRRWFLDKLVDEIGVGKVYDRGSVSDYQLSQIKPLHNFLTQLQPFLKLKQKQANLALKIIEQLPSAKESPDKFLRVCTWVDQIAALNDSKTRKTTSETVRAVLLSLPGSVGGLSPSQASSAASSASSSPGSGISEALRAGATKSKEFLLYLAGFVDGDGSIMAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 341 - protein, 350 aa, artificial sequence
  MHP107(D6)
MNTKYNKEFLLHLAGFVDGDGSIMAAISPNQRCKFKHQLRLTFTVTQKTRRRWFLDKLVDEIGVGKVYDRGSVSDYQLSQIKPLHNFLTQLQPFLKLKQKQANLALKIIEQLPSAKESPDKFLRVCTWVDQIAALNDSKTRKTTSETVRAVLLSLPGSVGGLSPSQASSAASSASSSPGSGISEALRAGATKSKEFLLYLAGFVDGDGSIKAQIDPNQSYKFKHQLRLRFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 342 - DNA, 1050 bp, artificial sequence
  MHP107 yeast;
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgcagaggcgctggttcctcgacaagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 343 - DNA, 1050 bp, artificial sequence
  MHP107(C1)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgagaaggcgctggattctcgataagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaaacactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggattttagataaattagtggatgaaataggcgtcgggcatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggccgatagaatagccgcgttaaatgattcaaaaacgaggaaaaccacgagcgaaaccgtcagagccgtgttagatagtttatcagaaaagaagaaaagcagtccg

SEQ ID NO: 344 - DNA, 1050 bp, artificial sequence
  MHP107(C2)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgcagaggcgctggttcctcgacaagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagagtctgtacctgggtggatcagatagccgcgttaaatgattcaaaaacgaggaaaaccacgagcgaaaccgtcagagccgtgttagatagtttatcagaaaagaagaaaagcagtccg

SEQ ID NO: 345 - DNA, 1050 bp, artificial sequence
  MHP107(C3)
atgaacaccaagtacaacaaggagttcctgctctacctggccggcttcgtggacggcgacggctccatcatcgcggcgatctccccgaaccagaggtgcaagttcaagcaccagctccgcctgaccttcaccgtgacccagaagacgagaaggcgctggtttctcgatgagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggcccaaatagatcccaatcaatcttataaatttaaacatcaattaaggttaagatttcaggtcacgcaaaaaacccagcgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 346 - DNA, 1050 bp, artificial sequence
  MHP107(C4)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgagaaggcgctggttcctcgacaagctggtcgacgagatcggggtgggcaaggtctacgaccgcgggtcggtgtccgactaccagctctccagaatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgacagaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 347 - DNA, 1050 bp, artificial sequence
  MHP107(C5)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgagaaggcgctggattctcgatgagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctagactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 348 - DNA, 1050 bp, artificial sequence
  MHP107(C5)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgagaaggcgctggattctcgacaagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccagcgtaggtggattttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 349 - DNA, 1050 bp, artificial sequence
  MHP107(D2)
atgaacaccaagtacaacaaggagttcctgctctacctggccggcttcgtggacggcgacggctccatcatcgcggcgatctccccgaaccagtcctgcaagttcaagcaccagctccgcctgaccttcaccgtgacccagaagacgagaaggcgctggattctcttaaagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggccgatagaatagccgcgttaaatgattcaaaaacgaggaaaaccacgagcgaaaccgtcagagccgtgttattgagtttatcagaaaagaagaaaagcagtccg

SEQ ID NO: 350 - DNA, 1050 bp, artificial sequence
  MHP107(D3)
atgaacaccaagtacaacaaggagttcctgctccatctggccggcttcgtggacggcgacggctccatcatggcggcgatctccccgaaccagtcctgcaagttcaagcaccagctccgcctgaccttcaccgtgacccagaagacgcagaggcgctggttcctcgacaagctggtcgacgagatcggggtgggcaaggtctacgaccgcgggtcggtgtccgactaccagctctccagaatcaagcccctgcacaacttcctcacccagctccagccgttcctcaagctgaagcagaagcaggcgaacctcgccctgaagatcatcgagcagctcccctcggccaaggagtccccggacaagttcctgagagtgtgcacgtgggccgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagccttaaaaataatagaacaattaccgagcgcgaaagaaagtcccgataaatttttagaagtctgtacctgggccgatagaatagccgcgttaaatgattcaaaaacgaggaaaaccacgagcgaaaccgtcagagccgtgttagatagtttatcagaaaagaagaaaagcagtccg

SEQ ID NO: 351 - DNA, 1050 bp, artificial sequence
  MHP107(D4)
atgaacaccaagtacaacaaggagttcctgctccatctggccggcttcgtggacggcgacggctccatcatcgcggcgatctccccgaaccagtcctgcaagttcaagcaccagctccgcctgaccttcaccgtgacccagaagacgagaaggcgctggtttctcgataagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctggaggtgtgcacgtgggccgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 352 - DNA, 1050 bp, artificial sequence
  MHP107(D5)
atgaacaccaagtacaacaaggagttcctgctccatctggccggcttcgtggacggcgacggctccatcatggcggcgatctccccgaaccagtcctgcaagttcaagcaccagctccgcctgaccttcaccgtgacccagaagacgagaaggcgctggattctcgatgagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctgagagtgtgcacgtgggccgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagccttaaaaataatagaacaattaccgagcgcgaaagaaagtcccgataaatttttaagagtctgtacctgggtggatcagatagccgcgttaaatgattcaaaaacgaggaaaaccacgagcgaaaccgtcagagccgtgttagatagtttatcagaaaagaagaaaagcagtccg

SEQ ID NO: 353 - DNA, 1050 bp, artificial sequence
  MHP107(D1)
atgaacaccaagtacaacaaggagttcctgctccatctggccggcttcgtggacggcgacggctccatcatggcggcgatctccccgaaccagtcctgcaagttcaagcaccagctccgcctgaccttcaccgtgacccagaagacgcagaggcgctggttcctcgacaagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 354 - DNA, 1050 bp, artificial sequence
  MHP107(D6)
atgaacaccaagtacaacaaggagttcctgctccatctggccggcttcgtggacggcgacggctccatcatggcggcgatctccccgaaccagaggtgcaagttcaagcaccagctccgcctgaccttcaccgtgacccagaagacgagaaggcgctggtttctcgataagctggtcgacgagatcggggtgggcaaggtctacgaccgcgggtcggtgtccgactaccagctctcccagatcaagcccctgcacaacttcctcacccagctccagccgttcctcaagctgaagcagaagcaggcgaacctcgccctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctgctatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataaaagcccaaatagatcccaatcaatcttataaatttaaacatcaattaaggttaagatttcaggtcacgcaaaaaacccaacgtaggtggtttttagataaattagtggatgaaataggcgtcgggtatgtgtatgataggggcagcgtcagtgattatatattaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 355 - DNA, 22 bp, Zea mays
caggctctcgtaaatgcgcctg

SEQ ID NO: 356 - protein, 350 aa, artificial sequence
  ZM6.3yeast
MNTKYNKEFLLYLAGFVDGDGSIKAQIKPEQSYKFKHRLRLTFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 357 - protein, 350 aa, artificial sequence
  ZM6.3(G1)
MNTKYNKEFLLYLAGFVDGDGSIKAQIKPEQRYKFKHRLRLTFQVTQKTRRRWILDKLVDEIGVGYVYDRGSVSDYILSRIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 358 - protein, 350 aa, artificial sequence
  ZM6.3(G2)
MNTKYNKEFLLHLAGFVDGDGSIKAQIKPEQRYKFKHRLRLTFQVTQKTQRRWILLKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 359 - protein, 350 aa, artificial sequence
  ZM6.3(G3)
MNTKYNKEFLLYLAGFVDGDGSIKAQIKPEQSYKFKHRLRLTFQVTQKTRRRWILDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 360 - protein, 350 aa, artificial sequence
  ZM6.3(G4)
MNTKYNKEFLLHLAGFVDGDGSIKAQIKPEQRYKFKHRLRLTFQVTQKTQRRWFLDKLVDEIGVGYVYDRGSVSDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 361 - protein, 350 aa, artificial sequence
  ZM6.3(G5)
MNTKYNKEFLLHLAGFVDGDGSIKAQIKPEQSYKFKHRLRLTFQVTQKTQRRWFLDKLVDEIGVGYVYDRGSASDYILSQIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 362 - protein, 350 aa, artificial sequence
  ZM6.3(G6)
MNTKYNKEFLLYLAGFVDGDGSIKAQIKPEQSYKFKHRLRLTFQVTQKTQRRWILDELVDEIGVGYVYDRGSVSDYILSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTRRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 363 - protein, 350 aa, artificial sequence
  ZM6.3(H1)
MNTKYNKEFLLHLAGFVDGDGSIMAQIKPEQRYKFKHRLRLTFQVTQKTQRRWFLDKLVDEIGVGYVYDRGSVSDYILSQIKPLHNFLTQLQPFLKLKQKQANLVLKIIEQLPSAKESPDKFLRVCTWADQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWILDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 364 - protein, 350 aa, artificial sequence
  ZM6.3(H2)
MNTKYNKEFLLHLAGFVDGDGSIKAQIKPEQSYKFKHRLRLTFQVTQKTQRRWFLDKLVDEIGVGYVYDRGSVSDYILSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTRRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLLSLSEKKKSSP

SEQ ID NO: 365 - protein, 350 aa, artificial sequence
  ZM6.3(H3)
MNTKYNKEFLLHLAGFVDGDGSIKAQIKPEQSYKFKHRLRLTFQVTQKTRRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 366 - protein, 350 aa, artificial sequence
  ZM6.3(H5)
MNTKYNKEFLLHLAGFVDGDGSIKAQIKPEQSYKFKHRLRLTFQVTQKTQRRWILDKLVDEIGVGYVYDRGSVSDYILSQIKPLHNFLTQLQPFLKLKQKQANLALKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 367 - protein, 350 aa, artificial sequence
  ZM6.3(H6)
MNTKYNKEFLLHLAGFVDGDGSIKAQIKPEQRYKFKHRLRLTFQVTQKTQRRWILDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 368 - protein, 350 aa, artificial sequence
  ZM6.3(1)
MNTKYNKEFLLYLAGFVDSDGSIKAQIKPEQSYKFNHRLRLTFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGVSEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKNSP

SEQ ID NO: 369 - protein, 350 aa, artificial sequence
  ZM6.3(3)
MNTKYNKEFLLYLAGFVDGDGSIKAQIKPEQSYKFKHRLRLTFQVTQKTQRRWFLDKLVDEIGVGYVYDRGSVSDYILSQIKPLHNFLTQLQPFLKLKQKQANLVLKIIEQLPSAKGSPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 370 - protein, 350 aa, artificial sequence
  ZM6.3(4)
MNTKYNKEFLLYLAGFVDGDGSIKAQIKPEQSYKFKHRLRLTFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIMASIKPEQSYKFKHRLRLTFTVTQKTQRRWILDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKCSP

SEQ ID NO: 371 - protein, 350 aa, artificial sequence
  ZM6.3(5)
MNTKYNKEFLLYLAGFVDGDGSIKAQIKPEQSYKFKHRLRLTFQVTQKTQRRWFLDKLVDEVGVGYVYDRGSVSDYILSQIKPLHNFLTQLQPFLKLKQKQANLVLKIIEQLPSAKESPDKFLEVCTWVDQIAALNDSKTRKTTSESVRAVLDSLPGSVGGLSPSQASSAASSASSSPGSGISEALRAGATKSKEFLLYLAGVVDGDGSIMASIKPEQSYKFKHRLRLTFTVTQKTQRRWFLDKLVDEIGVGYVYDQGSVSHYRLSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 372 - DNA, 1050 bp, artificial sequence
  ZM6.3 yeast
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 373 - DNA, 1050 bp, artificial sequence
  ZM6.3(G1)
atgaacaccaagtacaacaaggagttcctgctctacctggccggcttcgtggacggcgacggctccatcaaggcgcagatcaagccggagcagaggtacaagttcaagcaccgcctccgcctgaccttccaggtgacccagaagacgagaaggcgctggatcctcgataagctggtcgacgagatcggggtgggctacgtctacgaccgcgggtcggtgtccgactacatcctctccagaatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 374 - DNA, 1050 bp, artificial sequence
  ZM6.3(G2)
atgaacaccaagtacaacaaggagttcctgctccatctggccggcttcgtggacggcgacggctccatcaaggcgcagatcaagccggagcagaggtacaagttcaagcaccgcctccgcctgaccttccaggtgacccagaagacgcagaggcgctggatcctcttaaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 375 - DNA, 1050 bp, artificial sequence
  ZM6.3(G3
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgagaaggcgctggatcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 376 - DNA, 1050 bp, artificial sequence
  ZM6.3(G4)
atgaacaccaagtacaacaaggagttcctgctccatctggccggcttcgtggacggcgacggctccatcaaggcgcagatcaagccggagcagaggtacaagttcaagcaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 377 - DNA, 1050 bp, artificial sequence
  ZM6.3(G5)
atgaacaccaagtacaacaaggagttcctgctccatctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgagatcggggtgggctacgtctacgaccgcgggtcggcttccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 378 - DNA, 1050 bp, artificial sequence
  ZM6.3(G6)
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgcagaggcgctggatcctcgatgagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgcgctgaagatcatcgagcagctcccctcggccaaggagtccccggacaagttcctgagagtgtgcacgtgggtggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaaccagacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcagatagccgcgttaaatgattcaaaaacgaggaaaaccacgagcgaaaccgtcagagccgtgttagatagtttatcagaaaagaagaaaagcagtccg

SEQ ID NO: 379 - DNA, 1050 bp, artificial sequence
  ZM6.3(H1)
atgaacaccaagtacaacaaggagttcctgctccatctggccggcttcgtggacggcgacggctccatcatggcgcagatcaagccggagcagaggtacaagttcaagcaccgcctccgcctgaccttccaggtgacccagaagacgcagaggcgctggttcctcgataagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggcggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccagcgtaggtggatcttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagagtctgtacctgggtggatcagatagccgcgttaaatgattcaaaaacgaggaaaaccacgagcgaaaccgtcagagccgtgttagatagtttatcagaaaagaagaaaagcagtccg

SEQ ID NO: 380 - DNA, 1050 bp, artificial sequence
  ZM6.3(H2)
atgaacaccaagtacaacaaggagttcctgctccatctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgcgctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggaatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaaccagacgtaggtggttcttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttattaagtttatcagaaaagaagaaaagcagtccg

SEQ ID NO: 381 - DNA, 1050 bp, artificial sequence
  ZM6.3(H3)
atgaacaccaagtacaacaaggagttcctgctccatctggccggcttcgtggacggcgacggctccatcaaggcgcagatcaagccggagcagtcctacaagttcaagcaccgcctccgcctgaccttccaggtgacccagaagacgagaaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagagtctgtacctgggtggatcagatagccgcgttaaatgattcaaaaacgaggaaaaccacgagcgaaaccgtcagagccgtgttagatagtttatcagaaaagaagaaaagcagtccg

SEQ ID NO: 382 - DNA, 1050 bp, artificial sequence
  ZM6.3(H4)
atgaacaccaagtacaacaaggagttcctgctccatctggccggcttcgtggacggcgacggctccatcaaggcgcagatcaagccggagcagtcctacaagttcaagcaccgcctccgcctgaccttccaggtgacccagaagacgcagaggcgctggatcctcgataagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgcgctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 383 - DNA, 1050 bp, artificial sequence
  ZM6.3(H6)
atgaacaccaagtacaacaaggagttcctgctccatctggccggcttcgtggacggcgacggctccatcaaggcgcagatcaagccggagcagaggtacaagttcaagcaccgcctccgcctgaccttccaggtgacccagaagacgcagaggcgctggatcctcgataagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 384 - DNA, 1050 bp, artificial sequence
  ZM6.3(1)
atgaacaccaagtacaacaaggagttcctgctctacctggccggcttcgtggacagcgacggctccatcaaggcgcagatcaagccggagcagtcctacaagttcaaccaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcaggggtctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaagaacagtccg

SEQ ID NO: 385 - DNA, 1050 bp, artificial sequence
  ZM6.3(3)
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggggtccccggacaagttcctggaggtgtgcacgtgggtcgaccagatcgcggccctcaacgacagcaagacccgcaagacgacctcggagacggtgcgggcagtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 386 - DNA, 1050 bp, artificial sequence
  ZM6.3(4)
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccgagcaatcttataaatttaaacatagattaaggttaacatttacggtcacgcaaaaaacccaacgtaggtggattttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaatgcagtccg

SEQ ID NO: 387 - DNA, 1050 bp, artificial sequence
  ZM6.3(5)
atgaacaccaagtacaacaaggagttcctgctctacctggccggcttcgtggacggcgacggctccatcaaggcgcagatcaagccggagcagtcctacaagttcaagcaccgcctccgcctgaccttccaggtgacccagaagacgcagaggcgctggttcctcgacaagctggtcgacgaggtcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagtcggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcgggggttgtcgatggggatgggagtataatggccagtataaaacccgagcaatcttataaatttaaacatagattaaggttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcggatcaaatagccgcgttaaatgattcaaaaacgaggaaaaccacgagcgaaaccgtcagagccgtgttagatagtttatcagaaaagaagaaaagcagtccg

SEQ ID NO: 388 - DNA, 22 bp, zea mays
attgctctctcacatactttta

SEQ ID NO: 389 - protein, 350 aa, artificial sequence
  ZM6.22v2(yeast)
MNTKYNKEFLLYLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 390 - protein, 350 aa, artificial sequence
  ZM6.22v2(J2)
MNTKYNKEFLLHLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 391 - protein, 350 aa, artificial sequence
  ZM6.22v2(J3)
MNTKYNKEFLLYLAGFVDGDGSIKAQIKPQQSCKFKHALRLTFQVTQKTRRRWFLLKLVDEIGVGYVYDRGSVSDYILSEIKPLHNFLTQLQPFLKLKQKQANLVLKIIEQLPSAKESPDKFLEVCTWVDRIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTRRRWFLDKLVDEIGVGYVYDQGSVSHYRLSQIKPLHNFLTQLQPFLKLKQKQANLVLKIIEQLPSAKESPDKFLRVCTWADRIAALNDSKTRKTTSETVRAVLDSLSEKKKSSP

SEQ ID NO: 392 - protein, 350 aa, artificial sequence
  ZM6.22v2(J4)
MNTKYNKEFLLHLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTRRRWFLDKLVDEIGVGYVYDQGSVSHYRLSQIKPLHNFLTQLQPFLKLKQKQANLVLKIIEQLPSAKESPDKFLEVCTWVDRIAALNDSKTRKTTSETVRAVLDSLSEKKKSSP

SEQ ID NO: 393 - protein, 350 aa, artificial sequence
  ZM6.22v2(J5)
MNTKYNKEFLLHLAGFVDGDGSIKAQIKPQQSCKFKHALRLTFQVTQKTQRRWFLDKLVDEIGVGYVYDRGSVSDYILSEIKPLHNFLTQLQPFLKLKQKQANLALKIIEQLPSAKESPDKFLRVCTWVDQIAALNDSKTRKTTSETVRAVLLSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 394 - protein, 350 aa, artificial sequence
  ZM6.22v2(I2)
MNTKYNKEFLLHLAGFVDGDGSIKAQIKPQQSCKFKHALRLTFQVTQKTRRRWFLDKLVDEIGVGYVYDRGSVSDYILSEIKPLHNFLTQLQPFLKLKQKQANLVLKIIEQLPSAKESPDKFLRVCTWADRIAALNDSKTRKTTSETVRAVLDSLPGSVGGLSPSQASSAASSASSSPGSGISEALRAGATKSKEFLLYLAGFVDGDGSIMASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLRVCTWADRIAALNDSKTRKTTSETVRAVLDSLSEKKKSSP

SEQ ID NO: 395 - protein, 350 aa, artificial sequence
  ZM6.22v2(I3)
MNTKYNKEFLLHLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 396 - protein, 350 aa, artificial sequence
  ZM6.22v2(I4)
MNTKYNKEFLLYLAGFVDGDGSIKAQIKPQQSCKFKHALRLTFQVTQKTQRRWFLDELVDEIGVGYVYDRGSVSDYILSEIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLALKIIEQLPSAKESPDKFLEVCTWADRIAALNDSKTRKTTSETVRAVLDSLSEKKKSSP

SEQ ID NO: 397 - protein, 350 aa, artificial sequence
  ZM6.22v2(I5)
MNTKYNKEFLLYLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTRRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 398 - protein, 350 aa, artificial sequence
  ZM6.22v2(I6)
MNTKYNKEFLLHLAGFVDGDGSIKAQIKPQQSCKFKHALRLTFQVTQKTQRRWFLLELVDEIGVGYVYDRGSVSDYILSEIKPLHNFLTQLQPFLKLKQKQANLALKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWADRIAALNDSKTRKTTSETVRAVLDSLSEKKKSSP

SEQ ID NO: 399 - protein, 350 aa, artificial sequence
  ZM6.22v2(I7)
MNTKYNKEFLLHLAGFVDGDGSIKAQIKPQQSCKFKHALRLTFQVTQKTRRRWFLDELVDEIGVGYVYDRGSVSDYILSEIKPLHNFLTQLQPFLKLKQKQANLVLKIIEQLPSAKESPDKFLRVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWVDRIAALNDSKTRKTTSETVRAVLDSLSEKKKSSP

SEQ ID NO: 400 - protein, 350 aa, artificial sequence
  ZM6.22v2(I8)
MNTKYNKEFLLHLAGFVDGDGSIKAQIKPQQSCKFKHALRLTFQVTQKTQRRWFLDKLVDEIGVGYVYDRGSVSDYILSEIKPLHNFLTQLQPFLKLKQKQANLVLKIIEQLPSAKESPDKFLRVCTWADQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 401 - protein, 350 aa, artificial sequence
  ZM6.22v2(I9)
MNTKYNKEFLLYLAGFVDGDGSIKAQIKPQQSCKFKHALRLTFQVTQKTQRRWFLDELVDEIGVGYVYDRGSVSDYILSEIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWADRIAALNDSKTRKTTSETVRAVLDSLSEKKKSSP

SEQ ID NO: 402 - protein, 350 aa, artificial sequence
  ZM6.22v2(J7)
MNTKYNKEFLLHLAGFVDGDGSIKAQIKPQQSCKFKHALRLTFQVTQKTQRRWFLLKLVDEIGVGYVYDRGSVSDYILSEIKPLHNFLTQLQPFLKLKQKQANLALKIIEQLPSAKESPDKFLRVCTWADRIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 403 - protein, 350 aa, artificial sequence
  ZM6.22v2(J8)
MNTKYNKEFLLHLAGFVDGDGSIKAQIKPQQSCKFKHALRLTFQVTQKTQRRWILDELVDEIGVGYVYDRGSVSDYILSEIKPLHNFLTQLQPFLKLKQKQANLALKIIEQLPSAKESPDKFLRVCTWVDRIAALNDSKTRKTTSETVRAVLDSLPGSVGGLSPSQASSAASSASSSPGSGISEALRAGATKSKEFLLYLAGFVDGDGSIIASIKPNQCYKFKHQLSLTFTVTQKTQRRWFLDKLVDEIGVGYVYDQGSVSHYRLSQIKPLHNFLTQLQPFLKLKQKQANLVLKIIEQLPSAKESPDKFLRVCTWVDQIAALNDSKTRKTTSETVRAVLDSLSEKKKSSP

SEQ ID NO: 404 - DNA, 1050 bp, artificial sequence
  ZM6.22v2 yeast
atgaacaccaagtacaacaaggagttcctgctctacctggccggcttcgtggacggcgacggctccatcaaggcgcagatcaagccgcagcagtcctgcaagttcaagcacgcgctccgcctgaccttccaggtgacccagaagacgcagaggcgctggttcctcgacaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 405 - DNA, 1050 bp, artificial sequence
  ZM6.22v2(J2)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggttcctcgacaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 406 - DNA, 1050 bp, artificial sequence
  ZM6.22v2(J3
atgaacaccaagtacaacaaggagttcctgctctacctggccggcttcgtggacggcgacggctccatcaaggcgcagatcaagccgcagcagtcctgcaagttcaagcacgcgctccgcctgaccttccaggtgacccagaagacgagaaggcgctggtttctccttaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtagacagaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaaccagacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggcagatagaatagccgcgttaaatgattcaaaaacgaggaaaaccacgagcgaaaccgtcagagccgtgttagatagtttatcagaaaagaagaaaagcagtccg

SEQ ID NO: 407 - DNA, 1050 bp, artificial sequence
  ZM6.22v2(J4)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggttcctcgacaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaaccagacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtagatagaatagccgcgttaaatgattcaaaaacgaggaaaaccacgagcgaaaccgtcagagccgtgttagatagtttatcagaaaagaagaaaagcagtccg

SEQ ID NO: 408 - DNA, 1050 bp, artificial sequence
  ZM6.22v2(J5)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggtttctcgataagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgcactgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctgttatccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 409 - DNA, 1050 bp, artificial sequence
  ZM6.22v2(I2)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgagaaggcgctggttcctcgataagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggcagacagaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatggccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggcagatagaatagccgcgttaaatgattcaaaaacgaggaaaaccacgagcgaaaccgtcagagccgtgttagatagtttatcagaaaagaagaaaagcagtccg

SEQ ID NO: 410 - DNA, 1050 bp, artificial sequence
  ZM6.22v2(I3)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggttcctcgacaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 411 - DNA, 1050 bp, artificial sequence
  ZM6.22v2(I4)
atgaacaccaagtacaacaaggagttcctgctctacctggccggcttcgtggacggcgacggctccatcaaggcgcagatcaagccgcagcagtcctgcaagttcaagcacgcgctccgcctgaccttccaggtgacccagaagacgcagaggcgctggttcctcgatgagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagctttaaaaataatagaacaattaccgagcgcgaaagaaagtcccgataaatttttagaagtctgtacctgggcagatagaatagccgcgttaaatgattcaaaaacgaggaaaaccacgagcgaaaccgtcagagccgtgttagatagtttatcagaaaagaagaaaagcagtccg

SEQ ID NO: 412 - DNA, 1050 bp, artificial sequence
  ZM6.22v2(I5)
atgaacaccaagtacaacaaggagttcctgctctacctggccggcttcgtggacggcgacggctccatcaaggcgcagatcaagccgcagcagtcctgcaagttcaagcacgcgctccgcctgaccttccaggtgacccagaagacgcagaggcgctggttcctcgataagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaaccagacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 413 - DNA, 1050 bp, artificial sequence
  ZM6.22v2(I6)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcaaaggcgctggtttctccttgagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgcactgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcagatagaatagccgcgttaaatgattcaaaaacgaggaaaaccacgagcgaaaccgtcagagccgtgttagatagtttatcagaaaagaagaaaagcagtccg

SEQ ID NO: 414 - DNA, 1050 bp, artificial sequence
  ZM6.22v2(I7)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgagaaggcgctggtttctcgatgagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtagatagaatagccgcgttaaatgattcaaaaacgaggaaaaccacgagcgaaaccgtcagagccgtgttagatagtttatcagaaaagaagaaaagcagtccg

SEQ ID NO: 415 - DNA, 1050 bp, artificial sequence
  ZM6.22v2(I8)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggttcctcgacaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctgagagtgtgcacgtgggcagaccaaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 416 - DNA, 1050 bp, artificial sequence
  ZM6.22v2(I9)
atgaacaccaagtacaacaaggagttcctgctctacctggccggcttcgtggacggcgacggctccatcaaggcgcagatcaagccgcagcagtcctgcaagttcaagcacgcgctccgcctgaccttccaggtgacccagaagacgcaaaggcgctggtttctcgatgagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggcagatagaatagccgcgttaaatgattcaaaaacgaggaaaaccacgagcgaaaccgtcagagccgtgttagatagtttatcagaaaagaagaaaagcagtccg

SEQ ID NO: 417 - DNA, 1050 bp, artificial sequence
  ZM6.22v2(J7)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcagaggcgctggtttctccttaagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgcactgaagatcatcgagcagctcccctcggccaaggagtccccggacaagttcctgagagtgtgcacgtgggcagacagaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttagaagtctgtacctgggtagatcaaatagccgcgttaaatgattcaaaaacgaggaaaaccacgagcgaaaccgtcagagccgtgttagatagtttatcagaaaagaagaaaagcagtccg

SEQ ID NO: 418 - DNA, 1050 bp, artificial sequence
  ZM6.22v2(J8)
atgaacaccaagtacaacaaggagttcctgctccatctggccggcttcgtggacggcgacggctccatcaaggcgcagatcaagccgcagcagtcctgcaagttcaagcacgcgctccgcctgaccttccaggtgacccagaagacgcaaaggcgctggattctcgatgagctggtcgacgagatcggggtgggctacgtctacgaccgcgggtcggtgtccgactacatcctctccgagatcaagcccctgcacaacttcctcacccagctccagccgttcctcaagctgaagcagaagcaggcgaacctcgcactgaagatcatcgagcagctcccctcggccaaggagtccccggacaagttcctgagagtgtgcacgtgggtagacagaatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaagagtttttattatatttagcggggtttgtcgatggggatgggagtataatagccagtataaaacccaatcaatgttataaatttaaacatcaattaagtttaacatttacggtcacgcaaaaaacccaacgtaggtggtttttagataaattagtggatgaaataggcgtcgggtatgtgtatgatcagggcagcgtcagtcattataggttaagtcaaataaaaccgttacataattttttaacgcaattacaaccctttttaaaattaaaacaaaaacaagccaatttagtgttaaaaataatagaacaattaccgagcgcgaaagaaagtcccgataaatttttaagggtctgtacctgggtggatcaaatagccgcgttaaatgattcaaaaacgaggaaaaccacgagcgaaaccgtcagagccgtgttagatagtttatcagaaaagaagaaaagcagtccg

SEQ ID NO: 419 - DNA, 1050 bp, artificial sequence
  MS26+(7) no intron
atgaacaccaagtacaacaaggagttcctgctctacctggccggcatcgtggacggcgacggctccatcatcgcgcagatcgacccgcagcagtcctacaagttcaagcactccctccgcctgcgcttcaccgtgacccagaagacgcagaggcgctggttcctcgacaagctggtcgacgagatcggggtgggcaaggtccgcgaccgcgggtcggtgtccgactacatcctctgccagatcaagcccctgcacaacttcctcacccagctgcagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaaggactcagagctggagcaactaagtccaaggaattcctgctctacctggcgggcttcgtggacggcgacggctccatctgcgcgtccatcgacccgaaccagtcctgcaagttcaagcaccagctccgcctgcgcttcaccgtgacccagaagacgcagaggcgctggttcctcgacgagctggtcgacgagatcggggtgggcaaggtctacgaccgcgggtcggtgtccgactaccgcctctgccagatcaagcccctgcacaacttcctcacccagctccagccgttcctcaagcttaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccc

SEQ ID NO: 420 - protein, 38 aa, artificial sequence
  linker polypeptide of LIG3-4, MHP14, MHP77
PGSVGGLSPSQASSAASSASSSPGSGISEALRAGATKS

SEQ ID NO: 421 - protein, 38 aa, artificial sequence
  linker polypeptide of MHP14(10)
PGSVEVYRHLRHPAPHPRLPQARVQGSPKHSELEPKSK

SEQ ID NO: 422 - protein, 37 aa, artificial sequence
  linker polypeptide of MHP77(L9-01
PGSWEVYRHLRHPAPHPRLPQARVQGSPKHSELEQLS

SEQ ID NO: 423 - DNA, 22 bp, artificial sequence
  TS21 recognition sequence
ggcactctcgtgtgtgattaaa

SEQ ID NO: 424 - DNA, 22 bp, artificial sequence
  TS14 recognition sequence
cagacgtacgcaagtagctttg

SEQ ID NO: 425 - DNA, 1272 bp, artificial sequence
  plant-optimized TS21 meganuclease with a nuclear localization signal and an intron
atggcaccgaagaagaagcgcaaggtgcatatgaacaccaagtacaacaaggagttcctgctctacctggccggcttcgtggacggcgacggctccatcatggcgcagatcaagccgcagcagtcctgcaagttcaagcacgcgctccagctgaccttcaccgtgacccagaagacgcagaggcgctggttcctcgacaagctggtcgacgagatcggggtgggcaaggtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcaaggcgcagatcaagccgcgccagtcccgcaagttcaagcacgagctctccctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 426 - DNA, 1272 bp, artificial sequence
  plant-optimized nucleotide sequence of the TS21(7) meganuclease with a nuclear localization signal and an intron
atggcaccgaagaagaagcgcaaggtgcatatgaacaccaagtacaacaaggagttcctgctctacctggccggcatcgtggacggcgacggctccatcatggcgcagatcaagccgcagcagtcctgcaagttcaagcacgcgctccagctgaccttcaccgtgacccagaagacgcagaggcgctggttcctcgacaagctggtcgacgagatcggggtgggcaaggtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaaggactcagagctggagcaactaagtccaaggaattcctgctctacctggccggcttcgtggacggcgacggctccatcaaggcgcagatcaagccgcgccagtcccgcaagttcaagcacgagctctccctgaccttccaggtgacccagaagacgcagaggcgctggttcctcgacgagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggcggaccagatcgcggccctcaacgacagcaagacccgcaagacgacctcggagacggtgcgggcggttctagactccctcagcgagaagaagaagtcgtccccctga

SEQ ID NO: 427 - DNA, 1272 bp, artificial sequence
  plant-optimized nucleotide sequence of the TS21(15) meganuclease with a nuclear localization signal and an intron
atggcaccgaagaagaagcgcaaggtgcatatgaacaccaagtacaacaaggagttcctgctctacctggccggcttcgtggactccgacggctccatcatggcgcagatcaagccgcagcagtcctgcaagttcaagcacgcgctccagctgaccttcaccgtgacccagaagacgcagaggcgctggttcctcgacaagctggtcgacgagatcggggtgggcaaggtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcaaggcgcagatcaagccgcgccagtcccgcaagttcaagcacgagctctccctgaccttccaggtgacccagaagacgcagaggcgctggttcctcgacaagctggtcgacgagatcggggtgggctacgtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 428 - DNA, 1272 bp, artificial sequence
  plant-optimized nucleotide sequence of the TS21(B65) meganuclease with a nuclear localization signal and an intron
atggcaccgaagaagaagcgcaaggtgcatatgaacaccaagtacaacaaggagttcctgctctacctggccggcttcgtggacggcgacggctgcatcatggcgcagatcaagccgcagcagtcctgcaagttcaagcacgcgctccagctgaccttcaccgtgacccagaagacgaagaggcgctggttcctcgacaagctggtcgacgagatcggggtgggcaaggtctacgaccgcaagtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcaaggcgcagatcaagccgcgccagtcccgcaagttcaagcacgagctctccctgaccttccaggtgacccagaagacgcagaggcgctggttcctcgacaagctggtcgacgagatcggggtgggctacgtctacgaccgcaagtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 429 - protein, 360 aa, artificial sequence
  TS21 meganuclease
MAPKKKRKVHMNTKYNKEFLLYLAGFVDGDGSIMAQIKPQQSCKFKHALQLTFTVTQKTQRRWFLDKLVDEIGVGKVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIKPRQSRKFKHELSLTFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 430 - protein, 360 aa, artificial sequence
  TS21(7) meganuclease
MAPKKKRKVHMNTKYNKEFLLYLAGIVDGDGSIMAQIKPQQSCKFKHALQLTFTVTQKTQRRWFLDKLVDEIGVGKVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEGLRAGATKSKEFLLYLAGFVDGDGSIKAQIKPRQSRKFKHELSLTFQVTQKTQRRWFLDELVDEIGVGYVYDRGSVSDYILSQIKPLHNFLTQLQPFLKLKQKQANLVLKIIEQLPSAKESPDKFLEVCTWADQIAALNDSKTRKTTSETVRAVLDSLSEKKKSSP

SEQ ID NO: 431 - protein, 360 aa, artificial sequence
  TS21(15) meganuclease
MAPKKKRKVHMNTKYNKEFLLYLAGFVDSDGSIMAQIKPQQSCKFKHALQLTFTVTQKTQRRWFLDKLVDEIGVGKVYDRGSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIKPRQSRKFKHELSLTFQVTQKTQRRWFLDKLVDEIGVGYVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 432 - protein, 360 aa, artificial sequence
  TS21(B65) meganuclease
MAPKKKRKVHMNTKYNKEFLLYLAGFVDGDGCIMAQIKPQQSCKFKHALQLTFTVTQKTKRRWFLDKLVDEIGVGKVYDRKSVSDYILSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIKAQIKPRQSRKFKHELSLTFQVTQKTQRRWFLDKLVDEIGVGYVYDRKSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 433 - DNA, 1272 bp, artificial sequence
  plant-optimized nucleotide sequence of TS14 meganuclease with a nuclear localization signal and an intron; DNA
atggcaccgaagaagaagcgcaaggtgcatatgaacaccaagtacaacaaggagttcctgctctacctggccggcttcgtggacggcgacggctccatcatcgcgtccatcaagccggagcagtcctacaagttcaagcaccgcctctccctgaccttcaccgtgacccagaagacgcagaggcgctggttcctcgacaagctggtcgacgagatcggggtgggcaaggtctacgaccgcgggtcggtgtccgactaccgcctctcccagatcaagcccctgcacaacttcctcacccagctccagccgttcctgaagctcaagcagaagcaggccaacctcgtgctgaagatcatcgagcagctgccctccgccaaggaatccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgaagatcaccccgaaccagtcctacaagttcaagcaccagctccagctgcgcttcaccgtgacccagaagacgcagaggcgctggttcctcgacaagctggtcgacgagatcggggtgggcaaggtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 434 - DNA, 1272 bp, artificial sequence
  plant-optimized nucleotide sequence of TS14(15)meganuclease with a nuclear localization signal and an intron
atggcaccgaagaagaagcgcaaggtgcatatgaacaccaagtacaacaaggagttcctgctctacctggccggcttcgtggactccgacggctccatcatcgcgtccatcaagccggagcagtcctacaagttcaagcaccgcctctccctgaccttcaccgtgacccagaagacgcagaggcgctggttcctcgacaagctggtcgacgagatcggggtgggcaaggtctacgaccgcgggtcggtgtccgactaccgcctctcccagatcaagcccctgcacaacttcctcacccagctccagccgttcctgaagctcaagcagaagcaggccaacctcgtgctgaagatcatcgagcagctgccctccgccaaggaatccccggacaagttcctggaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgtgcacgtgggtggaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgaagatcaccccgaaccagtcctacaagttcaagcaccagctccagctgcgcttcaccgtgacccagaagacgcagaggcgctggttcctcgacaagctggtcgacgagatcggggtgggcaaggtctacgaccgcgggtcggtgtccgactacatcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggttctagactccctcagcgagaagaagaagtcgtccccctga

SEQ ID NO: 435 - protein, 360 aa, artificial sequence
  TS14 meganuclease
MAPKKKRKVHMNTKYNKEFLLYLAGFVDGDGSIIASIKPEQSYKFKHRLSLTFTVTQKTQRRWFLDKLVDEIGVGKVYDRGSVSDYRLSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAKITPNQSYKFKHQLQLRFTVTQKTQRRWFLDKLVDEIGVGKVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 436 - protein, 360 aa, artificial sequence
  TS14(15) meganuclease
MAPKKKRKVHMNTKYNKEFLLYLAGFVDSDGSIIASIKPEQSYKFKHRLSLTFTVTQKTQRRWFLDKLVDEIGVGKVYDRGSVSDYRLSQIKPLHNFLTQLQPFLKLKQKQANLVLKIIEQLPSAKESPDKFLEVCTWVDQIAALNDSKTRKTTSETVRAVLDSLPGSVGGLSPSQASSAASSASSSPGSGISEALRAGATKSKEFLLYLAGFVDGDGSIIAKITPNQSYKFKHQLQLRFTVTQKTQRRWFLDKLVDEIGVGKVYDRGSVSDYILSQIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 437 - protein, 9 aa, Artificial sequence
  LAGLIDADG motif
LAGLIDADG

SEQ ID NO: 438 - protein, 16 aa, Artificial sequence
  GIYXnYIG motif, n=10
  misc_feature (4)..(13): Xaa can be any naturally occurring amino acid
GIYXXXXXXXXXXYIG

SEQ ID NO: 439 - protein, 21 aa, Artificial sequence
  HXnNXmH motif, n=10, m=8
  misc_feature (2)..(11): Xaa can be any naturally occurring amino acid
  misc_feature (13)..(20): Xaa can be any naturally occurring amino acid
HXXXXXXXXXXNXXXXXXXXH

SEQ ID NO: 440 - protein, 30 aa, Artificial sequence
  His-Cys box or HXCXnCXXXXHXmC motif
  misc_feature (2)..(2): Xaa can be any naturally occurring amino acid
  misc_feature (4)..(7): Xaa can be any naturally occurring amino acid
  misc_feature (9)..(12): Xaa can be any naturally occurring amino acid
  misc_feature (14)..(29): Xaa can be any naturally occurring amino acid
HXCXXXXCXXXXHXXXXXXXXXXXXXXXXC

What is claimed:

1. An isolated or recombinant polynucleotide comprising a nucleotide sequence encoding a meganuclease polypeptide, said polypeptide comprising:

a) an amino acid sequence having at least 80% sequence identity to SEQ ID NO:1 and at least one amino acid modification at an amino acid position corresponding to a position of SEQ ID NO:1 selected from the group consisting of positions 16, 22, 50, 56, 59, 71, 64, 103, 121, 153, and combinations thereof; or, b) an amino acid sequence having at least 1, 2, 3, 4, 5, 6, 7, 8, 9 of any of the amino acid modifications of a).

2. The isolated or recombinant polynucleotide of claim 1, wherein said at least one amino acid modification comprises;
   a) an isoleucine (I) at a position corresponding to amino acid position 16 in SEQ ID NO: 1;
   b) a cysteine (C) at a position corresponding to amino acid position 22 in SEQ ID NO: 1;
   c) an arginine (R) or lysine (K) at a position corresponding to amino acid position 50 in SEQ ID NO: 1;
   d) a leucine (L) at a position corresponding to amino acid position 56 in SEQ ID NO: 1;
   e) a histidine (H) or alanine (A) at a position corresponding to amino acid position 59 in SEQ ID NO: 1;
   f) a lysine (K) at a position corresponding to amino acid position 71 in SEQ ID NO: 1;
   g) a valine (V) at a position corresponding to amino acid position 103 in SEQ ID NO: 1;
   h) a glycine (G) at a position corresponding to amino acid position 121 in SEQ ID NO: 1; or,
   i) a leucine (L) or a methionine (M) at a position corresponding to amino acid position 153 in SEQ ID NO:1.

3. The isolated or recombinant polynucleotide of claim 1, wherein said nucleotide sequence encodes a meganuclease polypeptide, wherein said polypeptide further comprises:
   a) an aspartic acid (D) at a position corresponding to amino acid position 2 in SEQ ID NO: 1;
   b) a histidine (H) at a position corresponding to amino acid position 12 in SEQ ID NO: 1;
   c) an isoleucine (I) at a position corresponding to amino acid position 16 in SEQ ID NO: 1;
   d) a serine (S) or an alanine (A) at a position corresponding to amino acid position 19 in SEQ ID NO: 1;
   e) a cysteine (C) at a position corresponding to amino acid position 22 in SEQ ID NO: 1;
   f) a leucine (L) at a position corresponding to amino acid position 23 in SEQ ID NO: 1;
   g) a methionine (M) at a position corresponding to amino acid position 24 in SEQ ID NO: 1;
   h) an arginine (R) or an alanine (A) at a position corresponding to amino acid position 28 in SEQ ID NO: 1;
   i) an arginine (R), alanine (A), glutamine (Q), cysteine (C), glycine (G), serine (S), threonine (T), leucine (L), glutamic acid (E), or a proline (P) at a position corresponding to amino acid position 30 in SEQ ID NO: 1;
   j) an arginine (R) at a position corresponding to amino acid position 31 in SEQ ID NO: 1;
   k) an arginine (R), alanine (A), lysine (K) glutamine (Q), glycine (G) or a leucine (L)at a position corresponding to amino acid position 32 in SEQ ID NO: 1;
   l) an asparagine (N) at a position corresponding to amino acid position 36 in SEQ ID NO: 1;
   m) a leucine (L) at a position corresponding to amino acid position 43 in SEQ ID NO: 1;
   n) an arginine (R) or lysine (K) at a position corresponding to amino acid position 50 in SEQ ID NO: 1;
   o) an isoleucine (I) or a leucine (L) at a position corresponding to amino acid position 54 in SEQ ID NO: 1;
   p) a leucine (L) at a position corresponding to amino acid position 56 in SEQ ID NO: 1;
   q) a glutamic acid (E) at a position corresponding to amino acid position 57 in SEQ ID NO: 1;
   r) an isoleucine (I) at a position corresponding to amino acid position 58 in SEQ ID NO: 1;
   s) a histidine (H) or alanine (A) at a position corresponding to amino acid position 59 in SEQ ID NO: 1;
   t) a valine (V) at a position corresponding to amino acid position 62 in SEQ ID NO: 1;
   u) a lysine (K) at a position corresponding to amino acid position 71 in SEQ ID NO: 1;
   v) a threonine (T) at a position corresponding to amino acid position 72 in SEQ ID NO: 1;
   w) an alanine (A) at a position corresponding to amino acid position 73 in SEQ ID NO: 1;
   x) a glycine (G) at a position corresponding to amino acid position 79 in SEQ ID NO: 1;
   y) an arginine (R) at a position corresponding to amino acid position 80 in SEQ ID NO: 1;
   z) a lysine (K) at a position corresponding to amino acid position 81 in SEQ ID NO: 1;
   aa) an arginine (R) at a position corresponding to amino acid position 82 in SEQ ID NO: 1;
   bb) an aspartic acid (D) at a position corresponding to amino acid position 86 in SEQ ID NO: 1;
   cc) a leucine (L) at a position corresponding to amino acid position 87 in SEQ ID NO: 1;
   dd) an isoleucine (I) at a position corresponding to amino acid position 91 in SEQ ID NO: 1;
   ee) an isoleucine (I) at a position corresponding to amino acid position 95 in SEQ ID NO: 1;
   ff) an arginine (R) at a position corresponding to amino acid position 98 in SEQ ID NO: 1;
   gg) a valine (V) at a position corresponding to amino acid position 103 in SEQ ID NO: 1;
   hh) an alanine (A) at a position corresponding to amino acid position 105 in SEQ ID NO: 1;
   ii) an arginine (R) at a position corresponding to amino acid position 111 in SEQ ID NO: 1;
   jj) a serine (S) at a position corresponding to amino acid position 113 in SEQ ID NO: 1;
   kk) a proline (P) at a position corresponding to amino acid position 114 in SEQ ID NO: 1;
   ll) an arginine (R) at a position corresponding to amino acid position 116 in SEQ ID NO: 1;
   mm) a an glycine (G) at a position corresponding to amino acid position 117 in SEQ ID NO: 1;
   nn) a threonine (T) at a position corresponding to amino acid position 118 in SEQ ID NO: 1;
   oo) a an glycine (G) at a position corresponding to amino acid position 121 in SEQ ID NO: 1;
   pp) an arginine (R) at a position corresponding to amino acid position 124 in SEQ ID NO: 1;
   qq) a cysteine (C) at a position corresponding to amino acid position 128 in SEQ ID NO: 1;
   rr) an alanine (A) at a position corresponding to amino acid position 129 in SEQ ID NO: 1;
   ss) an arginine (R) at a position corresponding to amino acid position 131 in SEQ ID NO: 1;
   tt) a valine (V) at a position corresponding to amino acid position 132 in SEQ ID NO: 1;
   uu) a serine (S) at a position corresponding to amino acid position 147 in SEQ ID NO: 1;
   vv) an alanine (A) at a position corresponding to amino acid position 151 in SEQ ID NO: 1;
   ww) a leucine (L) or a methionine (M) at a position corresponding to amino acid position 153 in SEQ ID NO: 1;
   xx) a tryptophan (W) at a position corresponding to amino acid position 159 in SEQ ID NO: 1;
   yy) a glutamic acid (E) at a position corresponding to amino acid position 160 in SEQ ID NO: 1;
   zz) a valine (V) at a position corresponding to amino acid position 161 in SEQ ID NO: 1;
   aaa) a tyrosine (Y) at a position corresponding to amino acid position 162 in SEQ ID NO: 1;

bbb) an arginine (R) at a position corresponding to amino acid position 163 in SEQ ID NO: 1;
ccc) a histidine (H) at a position corresponding to amino acid position 164 in SEQ ID NO: 1;
ddd) a leucine (L) at a position corresponding to amino acid position 165 in SEQ ID NO: 1;
eee) an arginine (R) at a position corresponding to amino acid position 166 in SEQ ID NO: 1;
fff) a histidine (H) at a position corresponding to amino acid position 167 in SEQ ID NO: 1;
ggg) a proline (P) at a position corresponding to amino acid position 168 in SEQ ID NO: 1;
hhh) an alanine (A) at a position corresponding to amino acid position 169 in SEQ ID NO: 1;
iii) a proline (P) at a position corresponding to amino acid position 170 in SEQ ID NO: 1;
jjj) a histidine (H) at a position corresponding to amino acid position 171 in SEQ ID NO: 1;
kkk) a proline (P) at a position corresponding to amino acid position 172 in SEQ ID NO: 1;
lll) an arginine (R) at a position corresponding to amino acid position 173 in SEQ ID NO: 1;
mmm) a leucine (L) at a position corresponding to amino acid position 174 in SEQ ID NO: 1;
nnn) a proline (P) at a position corresponding to amino acid position 175 in SEQ ID NO: 1;
ooo) a glutamine (Q) at a position corresponding to amino acid position 176 in SEQ ID NO: 1;
ppp) an alanine (A) at a position corresponding to amino acid position 177 in SEQ ID NO: 1;
qqq) an arginine (R) at a position corresponding to amino acid position 178 in SEQ ID NO: 1;
rrr) a valine (V) at a position corresponding to amino acid position 179 in SEQ ID NO: 1;
sss) a glutamine (Q) at a position corresponding to amino acid position 180 in SEQ ID NO: 1;
ttt) a valine (V) at a position corresponding to amino acid position 182 in SEQ ID NO: 1;
uuu) a proline (P) at a position corresponding to amino acid position 183 in SEQ ID NO: 1;
vvv) a lysine (K) at a position corresponding to amino acid position 184 in SEQ ID NO: 1;
www) a threonine (T) or a histidine (H) at a position corresponding to amino acid position 185 in SEQ ID NO: 1;
xxx) a serine (S) at a position corresponding to amino acid position 186 in SEQ ID NO: 1;
yyy) a glutamic acid (E) at a position corresponding to amino acid position 187 in SEQ ID NO: 1;
zzz) a leucine (L) at a position corresponding to amino acid position 188 in SEQ ID NO: 1;
aaaa) a glutamic acid (E) at a position corresponding to amino acid position 189 in SEQ ID NO: 1;
bbbb) a glutamine (Q) at a position corresponding to amino acid position 190 in SEQ ID NO: 1;
cccc) a leucine (L) at a position corresponding to amino acid position 191 in SEQ ID NO: 1;
dddd) an amino acid deletion at a position corresponding to amino acid position 192 in SEQ ID NO: 1;
eeee) a proline (P) at a position corresponding to amino acid position 194 in SEQ ID NO: 1;
ffff) a lysine (K) at a position corresponding to amino acid position 195 in SEQ ID NO: 1;
gggg) a serine (S) at a position corresponding to amino acid position 196 in SEQ ID NO: 1;
hhhh) a phenylalanine (F) at a position corresponding to amino acid position 197 in SEQ ID NO: 1;
iiii) an isoleucine (I) at a position corresponding to amino acid position 200 in SEQ ID NO: 1;
jjjj) a valine (V) at a position corresponding to amino acid position 203 in SEQ ID NO: 1;
kkkk) a leucine (L) at a position corresponding to amino acid position 204 in SEQ ID NO: 1;
llll) an alanine (A) or a serine (S) at a position corresponding to amino acid position 206 in SEQ ID NO: 1;
mmmm) a cysteine (C) at a position corresponding to amino acid position 209 in SEQ ID NO: 1;
nnnn) a leucine (L) at a position corresponding to amino acid position 222 in SEQ ID NO: 1;
oooo) a methionine (M) at a position corresponding to amino acid position 211 in SEQ ID NO: 1;
pppp) an isoleucine (I) at a position corresponding to amino acid position 232 in SEQ ID NO: 1;
qqqq) a serine (S) at a position corresponding to amino acid position 236 in SEQ ID NO: 1;
rrrr) a leucine (L) or an arginine (R) at a position corresponding to amino acid position 237 in SEQ ID NO: 1;
ssss) an isoleucine (I) or a leucine (L) at a position corresponding to amino acid position 241 in SEQ ID NO: 1;
tttt) a glutamic acid (E) at a position corresponding to amino acid position 244 in SEQ ID NO: 1;
uuuu) a histidine (H) at a position corresponding to amino acid position 246 in SEQ ID NO: 1;
vvvv) an aspartic acid (D) or histidine (H) at a position corresponding to amino acid position 253 in SEQ ID NO: 1;
wwww) an isoleucine (I) at a position corresponding to amino acid position 254 in SEQ ID NO: 1;
xxxx) a serine (S) at a position corresponding to amino acid position 258 in SEQ ID NO: 1;
yyyy) an arginine (R) at a position corresponding to amino acid position 267 in SEQ ID NO: 1;
zzzz) an isoleucine (I) at a position corresponding to amino acid position 278 in SEQ ID NO: 1;
aaaaa) a tyrosine (Y) at a position corresponding to amino acid position 281 in SEQ ID NO: 1;
bbbbb) a phenylalanine (F) at a position corresponding to amino acid position 282 in SEQ ID NO: 1;
ccccc) a threonine (T) at a position corresponding to amino acid position 289 in SEQ ID NO: 1;
ddddd) an alanine (A) at a position corresponding to amino acid position 292 in SEQ ID NO: 1;
eeeee) a glycine (G) at a position corresponding to amino acid position 308 in SEQ ID NO: 1;
fffff) an arginine (R) at a position corresponding to amino acid position 311 in SEQ ID NO: 1;
ggggg) an alanine (A) at a position corresponding to amino acid position 312 in SEQ ID NO: 1;
hhhhh) an alanine (A) at a position corresponding to amino acid position 316 in SEQ ID NO: 1;
iiiii) an arginine (R) at a position corresponding to amino acid position 318 in SEQ ID NO: 1;
jjjjj) a valine (V) at a position corresponding to amino acid position 319 in SEQ ID NO: 1;
kkkkk) an alanine (A) at a position corresponding to amino acid position 334 in SEQ ID NO: 1;
lllll) a phenylalanine (F) at a position corresponding to amino acid position 339 in SEQ ID NO: 1;
mmmmm) a glycine (G) or a leucine (L) at a position corresponding to amino acid position 340 in SEQ ID NO: 1;

nnnnn) a serine (S) at a position corresponding to amino acid position 342 in SEQ ID NO: 1;

ooooo) an asparagine (N) at a position corresponding to amino acid position 345 in SEQ ID NO: 1;

ppppp) an asparagine (N) at a position corresponding to amino acid position 346 in SEQ ID NO: 1;or, qqqqq) an asparagine (N) at a position corresponding to amino acid position 348 in SEQ ID NO: 1; or, rrrrr) any combination of a) to qqqqq).

4. The isolated or recombinant polynucleotide of claim 1, wherein said nucleotide sequence encodes a meganuclease polypeptide selected from the group consisting of SEQ ID NOs: 14, 15, 16, 17, 18, 19, 20, 21, 22, 23, 24, 25, 26, 27, 28, 29, 30, 31, 32, 33, 34, 35, 36, 37, and 38.

5. The isolated or recombinant polynucleotide of claim 1, wherein the polypeptide is capable of recognizing and cleaving a meganuclease recognition sequence of SEQ ID NO:2.

6. The isolated or recombinant polynucleotide of claim 1, wherein said polypeptide has an increased meganuclease activity when compared to a control meganuclease that lacks said amino acid modification.

7. The isolated or recombinant polynucleotide of claim 6, wherein said control meganuclease is SEQ ID NO: 1.

8. The isolated or recombinant polynucleotide of claim 6, wherein the increased meganuclease activity is evidenced by:
   a) a higher yeast assay score when compared to the control meganuclease that lacks said amino acid modification; or,
   b) a higher target site mutation rate when compared to the control meganuclease that lacks said amino acid modification; or,
   c) a higher in-vitro cutting when compared to the control meganuclease that lacks said amino acid modification; or,
   d) any combination of (a), (b) and (c).

9. The isolated or recombinant polynucleotide of claim 6, wherein the increased meganuclease activity is determined at 16° C., 24° C., 28° C., 30° C. or 37° C.

10. A recombinant DNA construct, comprising the isolated or recombinant polynucleotide of claim 1.

11. A cell comprising at least one polynucleotide of claim 1 or the recombinant DNA construct of claim 10, wherein said polynucleotide is heterologous to the cell.

12. The cell of claim 11, wherein said cell is a plant cell.

13. The cell of claim 11, wherein said plant cell is from a monocot.

14. The cell of claim 11, wherein said plant cell is from a dicot.

15. A plant comprising a plant cell of claim 12.

16. A transgenic seed produced by the plant of claim 15.

17. A method for producing a meganuclease having increased activity over a range of temperatures, the method comprising:

a) producing a variant meganuclease having at least 80% sequence identity to SEQ ID NO:1 by modifying at least one amino acid at an amino acid position corresponding to a position of SEQ ID NO:1 selected from the group consisting of positions 16, 22, 50, 56, 59, 71, 84, 103, 121, 153, and combinations thereof; and, b) screening said variant meganuclease from step a) for the ability to cleave a DNA target sequence over a range of temperatures between and including 16° C. to 37° C.;

c) selecting a variant meganuclease screened in step b) that is able to cleave a DNA target sequence over said temperature range.

18. The method of claim 17, wherein said range of temperatures comprises:
   a) 16° C.;
   b) 18° C.;
   c) 20° C.;
   d) 24° C.;
   e) 28° C.;
   f) 30° C.;
   g) 37° C.; or,
   h) any combination of a), b), c), d), e), f), h), g) and g).

19. A method for producing a meganuclease having an increased meganuclease activity when compared to a control meganuclease, the method comprising:

a) producing a variant meganuclease having at least 80% sequence identity to SEQ ID NO:1 by modifying at least one amino acid at an amino acid position corresponding to a position of SEQ ID NO:1 selected from the group consisting of positions 16, 22, 50, 56, 59, 71, 84, 103, 121, 153, and combinations thereof; and, b) screening said variant meganuclease from step a) for increased meganuclease activity when compared to a control meganuclease;

c) selecting a variant meganuclease screened in step b) with increased meganuclease activity when compared to a control meganuclease.

20. The method of claim 19, wherein the increased meganuclease activity is evidenced by:
   a) a higher yeast assay score when compared to the control meganuclease that lacks said amino acid modification; or,
   b) a higher target site mutation rate when compared to the control meganuclease that lacks said amino acid modification; or,
   c) a higher in-vitro cutting when compared to the control meganuclease that lacks said amino acid modification; or,
   d) any combination of (a), (b) and (c).

21. A composition comprising at least one polynucleotides of claim 1.

* * * * *